(12) United States Patent
Bao et al.

(10) Patent No.: US 8,173,866 B1
(45) Date of Patent: May 8, 2012

(54) MODULATION OF PLANT XYLAN SYNTHASES

(75) Inventors: Xiaoming Bao, Johnston, IA (US); Kanwarpal S. Dhugga, Johnston, IA (US); Deborah J. Wetterberg, Des Moines, IA (US); David A. Selinger, Johnston, IA (US); Rajeev Gupta, Johnston, IA (US)

(73) Assignee: Pioneer Hi-Bred International, Inc., Johnston, IA (US)

( * ) Notice: Subject to any disclaimer, the term of this patent is extended or adjusted under 35 U.S.C. 154(b) by 385 days.

(21) Appl. No.: 12/319,783

(22) Filed: Jan. 12, 2009

Related U.S. Application Data

(60) Provisional application No. 61/010,735, filed on Jan. 11, 2008.

(51) Int. Cl.
| | |
|---|---|
| *C12N 15/82* | (2006.01) |
| *C12N 15/63* | (2006.01) |
| *C12N 15/10* | (2006.01) |
| *A01H 5/00* | (2006.01) |
| *A01H 5/10* | (2006.01) |

(52) U.S. Cl. ..... 800/284; 800/278; 800/295; 435/320.1; 435/468; 536/23.1; 536/23.6

(58) Field of Classification Search .................. None
See application file for complete search history.

(56) References Cited

U.S. PATENT DOCUMENTS

| | | | |
|---|---|---|---|
| 7,091,398 B2 | 8/2006 | Dhugga et al. | |
| 7,098,380 B2 | 8/2006 | Dhugga et al. | |
| 7,579,443 B2 | 8/2009 | Dhugga et al. | |
| 7,592,505 B2 | 9/2009 | Bao et al. | |
| 2004/0034888 A1 * | 2/2004 | Liu et al. | 800/289 |
| 2007/0250961 A1 * | 10/2007 | Blaylock et al. | 800/283 |

* cited by examiner

*Primary Examiner* — Brent T Page
(74) *Attorney, Agent, or Firm* — Alston & Bird LLP

(57) ABSTRACT

The present invention provides compositions and methods for manipulation of plant arabinoxylose and plant xylan synthases. Compositions include novel nucleotide sequences encoding xylan synthases and biologically active variants thereof. The invention also includes the discovery xylan synthase activity is a property of CslA polypeptides. Further provided are methods for xylose manipulation using the sequences disclosed herein. One method comprises stably incorporating into the genome of a plant cell, a CslA encoding nucleotide sequence operably linked to a heterologous promoter and regenerating a stably transformed plant. Methods for enhancing digestibility of plants and improving gum production in plants are also provided.

24 Claims, 67 Drawing Sheets
(46 of 67 Drawing Sheet(s) Filed in Color)

Figure 5A

```
                    1                                                  50
AtCesA1    (1) ---------------------------------------MEASAGLVAGS
AtCesA10   (1) ---------------------------------------------MVAGS
ZmCesA1    (1) ------------------------------------MAANKGMVAGS
ZmCesA2    (1) ------------------------------------MAANKGMVAGS
ZmCesA3    (1) ------------------------------------MEANRGMVAGS
AtCesA2    (1) ---------------------------------------MNTGGRLIAGS
AtCesA9    (1) ---------------------------------------MNTGGRLIAGS
AtCesA5    (1) ---------------------------------------MNTGGRLIAGS
AtCesA6    (1) ---------------------------------------MNTGGRLIAGS
ZmCesA6    (1) --------------------------------------------------
ZmCesA7    (1) ---------------------------------------MEASAGLVAGS
ZmCesA8    (1) ---------------------------------------MEASAGLVAGS
AtCesA3    (1) --------------------------------------------------
ZmCesA4    (1) --------------------------------------------------
ZmCesA9    (1) --------------------------------------------------
ZmCesA5    (1) --------------------------------------------------
AtCesA7    (1) ---------------------------------------MEASAGLVAGS
ZmCesA12   (1) ---------------------------------------MEASAGLVAGS
ZmCesA13   (1) ---------------------------------------MEANAGLVAGS
AtCesA4    (1) --------------------------------------------------
ZmCesA10   (1) ----------------------------------MDAGSVTGGLAAGS
AtCesA8    (1) --------------------------------------------------
ZmCesA11   (1) --------------------------------------------------
AtCslD1    (1) ---------------MASSPPKKTLNSQSS--------------S---L
AtCslD2    (1) ---------------MASNKHFDKSRSNLS-------NNSDIQEPG--R
AtCslD3    (1) ---------------MASNNHFMNSRSNLS-------TNSDAAEAERHQ
OsCslD2    (1) ---------------MASSGGGGLRHSNSSRLSRMSYSGEDGRAQAPGG
OsCslD1    (1) ---------------MASKGILK----------------NGGKPPTAP
AtCslD4    (1) ---------------MASTPPQTSKKVRNNSG-----------------
OsCslD3    (1) ---------------MSTGPGKKAIRNAGGVGG-----G-AGPSAGGPR
AtCslD5    (1) MVKSAASQSPSPVTITVTPCKGSGDRSLGLTSPIPRASVITNQNSPLSSR
AtCslD6    (1) --------------------------------------------------
OsCslF7    (1) --------------------------------------------------
OsCslF1    (1) --------------------------------------------------
OsCslF2    (1) --------------------------------------------------
OsCslF4    (1) --------------------------------------------------
OsCslF3    (1) --------------------------------------------------
AtCslB1    (1) --------------------------------------------------
AtCslB2    (1) --------------------------------------------------
AtCslB4    (1) --------------------------------------------------
AtCslB3    (1) --------------------------------------------------
AtCslB5    (1) --------------------------------------------------
AtCslB6    (1) --------------------------------------------------
OsCslH1    (1) --------------------------------------------------
OsCslH2    (1) --------------------------------------------------
AtCslE1    (1) --------------------------------------------------
OsCslE1    (1) --------------------------------------------------
OsCslE5    (1) --------------------------------------------------
AtCslG1    (1) --------------------------------------------------
AtCslG2    (1) --------------------------------------------------
```

Figure 5B

```
   AtCslG3    (1)  --------------------------------------------------
  AtCslC12    (1)  --------------------------------------------------
    OsCslC1   (1)  --------------------------------------------------
    OsCslC7   (1)  --------------------------------------------------
    OsCslC9   (1)  --------------------------------------------------
    AtCslC5   (1)  --------------------------------------------------
    AtCslC8   (1)  --------------------------------------------------
    OsCslC3   (1)  --------------------------------------------------
    OsCslC2   (1)  --------------------------------------------------
    AtCslC4   (1)  --------------------------------------------------
    AtCslC6   (1)  --------------------------------------------------
    OsCslA8   (1)  --------------------------------------------------
    OsCslA2   (1)  --------------------------------------------------
    OsCslA4   (1)  --------------------------------------------------
    OsCslA5   (1)  --------------------------------------------------
    OsCslA7   (1)  --------------------------------------------------
    OsCslA3   (1)  --------------------------------------------------
   OsCslA11   (1)  --------------------------------------------------
    OsCslA6   (1)  --------------------------------------------------
    AtCslA1   (1)  --------------------------------------------------
   AtCslA10   (1)  --------------------------------------------------
   AtCslA15   (1)  --------------------------------------------------
   AtCslA11   (1)  --------------------------------------------------
   AtCslA14   (1)  --------------------------------------------------
    AtCslA3   (1)  --------------------------------------------------
    AtCslA7   (1)  --------------------------------------------------
    AtCslA2   (1)  --------------------------------------------------
     PoXylS   (1)  --------------------------------------------------
    OsCslA1   (1)  --------------------------------------------------
    OsCslA9   (1)  --------------------------------------------------
    AtCslA9   (1)  --------------------------------------------------
    PtCslA1   (1)  --------------------------------------------------
    PtCslA2   (1)  --------------------------------------------------
     CtManS   (1)  --------------------------------------------------
    PpCslA1   (1)  --------------------------------------------------
  Consensus   (1)
                   51                                              100
    AtCesA1   (12) YRRNELVRIRHESDG--GTKPLKNMNGQICQICGDDVGLAETGDVFVACN
   AtCesA10   (6)  YRRYEFVRNRDDSDD--GLKPLKDLNGQICQICGDDVGLTKTGNVFVACN
    ZmCesA1   (12) HNRNEFVMIRHDGDVPGSAKPTKSANGQVCQICGDSVGVSATGDVFVACN
    ZmCesA2   (12) HNRNEFVMIRHDGDAPVPAKPTKSANGQVCQICGDTVGVSATGDVFVACN
    ZmCesA3   (12) RGG--VVTIRHDGDG-AAAKQLKNVNEQICQICGDTLGLSATGDIFVACN
    AtCesA2   (12) HNRNEFVLINADESAR--IRSVQELSGQTCQICGDEIELTVSSELFVACN
    AtCesA9   (12) HNRNEFVLINADDTAR--IRSAEELSGQTCKICRDEIELTDNGEPFIACN
    AtCesA5   (12) HNRNEFVLINADESAR--IRSVEELSGQTCQICGDEIELSVDGESFVACN
    AtCesA6   (12) HNRNEFVLINADENAR--IRSVQELSGQTCQICRDEIELTVDGEPFVACN
    ZmCesA6   (1)  -------------------MDQRNGQVCQICGDDVGRNPDGEPFVACN
    ZmCesA7   (12) HNRNELVVIRRDGDP--GPKPPREQNGQVCQICGDDVGLAPGGDPFVACN
    ZmCesA8   (12) HNRNELVVIRRDRESGAAGGGAARRAEAPCQICGDEVGVGFDGEPFVACN
    AtCesA3   (1)  ------MESEGETAG----KPMKNIVPQTCQICSDNVGKTVDGDRFVACD
    ZmCesA4   (1)  -------MEGDADGV----KSGRRGGGQVCQICGDGVGTTAEGDVFAACD
    ZmCesA9   (1)  -------MEGDADGV----KSGRRGGGQVCQICGDGVGTTAEGDVFTACD
    ZmCesA5   (1)  --------MDGGDAT----NSGKHVAGQVCQICGDGVGTAADGDLFTACD
    AtCesA7   (12) HNRNELVVIHNHEEP----KPLKNLDGQFCEICGDQIGLTVEGDLFVACN
```

Figure 5C

```
ZmCesA12    (12)  HNRNELVLIRGHEDP----KPLRALSGQVCEICGDEVGLTVDGDLFVACN
ZmCesA13    (12)  HNRNELVLIRGHEDP----KPLRALSGQVCEICGDEVGLTVDGDLFVACN
 AtCesA4     (1)  --------------MQ---HRHSSFSAKICKVCGDEVKDDDNGQTFVACH
ZmCesA10    (15)  HMRDELHVMRAREEPN---AKVRSADVKTCRVCADEVGTREDGQPFVACA
 AtCesA8     (1)  --------------------MMESRSPICNTCGEEIGAKSNGEFFVACH
ZmCesA11     (1)  ------------------MMESAAAQSCAACGDDARA--------ACR
 AtCslD1    (18)  SRPPQAVKFGRRTSS---GRIVSLSRDDDMDVSGDYS-----GQNDYINY
 AtCslD2    (26)  PPAGHSVKFAQRTSS---GRYINYSRDDLDSELG---------GQDFMSY
 AtCslD3    (28)  QPVSNSVTFARRTPS---GRYVNYSRDDLDSELG---------SVDLTGY
 OsCslD2    (35)  GGDRPMVTFARRTHS---GRYVSYSRDDLDSELGNSGDMSPESGQEFLNY
 OsCslD1    (18)  SSAAPTVVFGRRTDS---GRFISYSRDDLDSEIS---------SVDFQDY
 AtCslD4    (18)  --SGQTVKFARRTSS---GRYVSLSRDNIELSGELS--------GDYSNY
 OsCslD3    (29)  GPAGQAVKFARRTSS---GRYVSLSREDIDMEGELA--------ADYTNY
 AtCslD5    (51)  ATRRTSISSGNRRSNGDEGRYCSMSVEDLTAETTN--------SECVLSY
 AtCslD6     (1)  --------MMDGESPLRHPRISHVSNSGSDFGSS----------SDYNKY
 OsCslF7     (1)  --------------------------------------------------
 OsCslF1     (1)  --------------------------------------------------
 OsCslF2     (1)  --------------------------------------------------
 OsCslF4     (1)  --------------------------------------------------
 OsCslF3     (1)  --------------------------------------------------
 AtCslB1     (1)  --------------------------------------------------
 AtCslB2     (1)  --------------------------------------------------
 AtCslB4     (1)  --------------------------------------------------
 AtCslB3     (1)  --------------------------------------------------
 AtCslB5     (1)  --------------------------------------------------
 AtCslB6     (1)  --------------------------------------------------
 OsCslH1     (1)  --------------------------------------------------
 OsCslH2     (1)  --------------------------------------------------
 AtCslE1     (1)  --------------------------------------------------
 OsCslE1     (1)  --------------------------------------------------
 OsCslE5     (1)  --------------------------------------------------
 AtCslG1     (1)  --------------------------------------------------
 AtCslG2     (1)  --------------------------------------------------
 AtCslG3     (1)  --------------------------------------------------
AtCslC12     (1)  --------------------------------------------------
 OsCslC1     (1)  --------------------------------------------------
 OsCslC7     (1)  --------------------------------------------------
 OsCslC9     (1)  --------------------------------------------------
 AtCslC5     (1)  --------------------------------------------------
 AtCslC8     (1)  --------------------------------------------------
 OsCslC3     (1)  --------------------------------------------------
 OsCslC2     (1)  --------------------------------------------------
 AtCslC4     (1)  --------------------------------------------------
 AtCslC6     (1)  --------------------------------------------------
 OsCslA8     (1)  --------------------------------------------------
 OsCslA2     (1)  --------------------------------------------------
 OsCslA4     (1)  --------------------------------------------------
 OsCslA5     (1)  --------------------------------------------------
 OsCslA7     (1)  --------------------------------------------------
 OsCslA3     (1)  --------------------------------------------------
OsCslA11     (1)  --------------------------------------------------
 OsCslA6     (1)  --------------------------------------------------
 AtCslA1     (1)  --------------------------------------------------
AtCslA10     (1)  --------------------------------------------------
```

Figure 5D

```
AtCslA15    (1)  --------------------------------------------------
AtCslA11    (1)  --------------------------------------------------
AtCslA14    (1)  --------------------------------------------------
AtCslA3     (1)  --------------------------------------------------
AtCslA7     (1)  --------------------------------------------------
AtCslA2     (1)  --------------------------------------------------
PoXylS      (1)  --------------------------------------------------
OsCslA1     (1)  --------------------------------------------------
OsCslA9     (1)  --------------------------------------------------
AtCslA9     (1)  --------------------------------------------------
PtCslA1     (1)  --------------------------------------------------
PtCslA2     (1)  --------------------------------------------------
CtManS      (1)  --------------------------------------------------
PpCslA1     (1)  --------------------------------------------------
Consensus  (51)
                 101                                             150
AtCesA1    (60)  ECAFPVCRPCYEYERK---------DGTQCCPQCKTRFRRHRGSPRVEGD
AtCesA10   (54)  ECGFPLCQSCYEYERK---------DGSQCCPQCKARFRRHNGSPRVEVD
ZmCesA1    (62)  ECAFPVCRPCYEYERK---------EGNQCCPQCKTRYKRQKGSPRVHGD
ZmCesA2    (62)  ECAFPVCRPCYEYERK---------EGNQCCPQCKTRYKRQKGSPRVHGD
ZmCesA3    (59)  ECAFPVCRPCYEYERK---------EGNQCCPQCKTRYKRHKGSPRVRGD
AtCesA2    (60)  ECAFPVCRPCYEYERR---------EGNQACPQCKTRYKRIKGSPRVDGD
AtCesA9    (60)  ECAFPTCRPCYEYERR---------EGNQACPQCGTRYKRIKGSPRVEGD
AtCesA5    (60)  ECAFPVCRPCYEYERR---------EGNQSCPQCKTRYKRIKGSPRVEGD
AtCesA6    (60)  ECAFPVCRPCYEYERR---------EGNQACPQCKTRFKRLKGSPRVEGD
ZmCesA6    (30)  ECAFPICRDCYEYERR---------EGTQNCPQCKTRFKRFKGCARVPGD
ZmCesA7    (60)  ECAFPVCRDCYEYERR---------EGTQNCPQCKTRYKRLKGCQRVTGD
ZmCesA8    (62)  ECAFPVCRACYEYERR---------EGSQACPQCRTRYKRLKGCPRVAGD
AtCesA3    (41)  ICSFPVCRPCYEYERK---------DGNQSCPQCKTRYKRLKGSPAIPGD
ZmCesA4    (40)  VCGFPVCRPCYEYERK---------DGTQACPQCKTKYKRHKGSPAIRGE
ZmCesA9    (40)  VCGFPVCRPCYEYERK---------DGTQACPQCKNKYKRHKGSPAIRGE
ZmCesA5    (39)  VCGFPVCRPCYEYERK---------DGTQACPQCKTKYKRHKGSPPVHGE
AtCesA7    (58)  ECGFPACRPCYEYERR---------EGTQNCPQCKTRYKRLRGSPRVEGD
ZmCesA12   (58)  ECGFPVCRPCYEYERR---------EGTQNCPQCKTRYKRLKGSPRVAGD
ZmCesA13   (58)  ECGFPVCRPCYEYERR---------EGTQNCPQCKTRYKRLKGSPRVAGD
AtCesA4    (34)  VCVYPVCKPCYEYRS----------NGNKCCPQCNTLYKRHK--------
ZmCesA10   (62)  ECGFPVCRPCYEYERS---------EGTQCCPQCNTRYKRQKGCPRVEGD
AtCesA8    (30)  ECSFPICKACLEYEFK---------EGRRICLRCG--------------N
ZmCesA11   (23)  ACSYALCRACLDEDAA---------EGRTTCARCGGDYAAINPARASEGT
AtCslD1    (60)  TVLMPPTPDNQPAGSS----------------------------------
AtCslD2    (64)  TVHIPPTPDNQPMDPS---------ISQKVEEQYVANSMFTGGFKSNTRA
AtCslD3    (66)  SVHIPPTPDNQPMDPS---------ISQKVEEQYVSNSLFTGGFNSVTRA
OsCslD2    (82)  HVTIPATPDNQPMDPA---------ISARVEEQYVSNSLFTGGFNSVTRA
OsCslD1    (56)  HVHIPMTPDNQPMDP----------AAGDEQQYVSSSLFTGGFNSVTRA
AtCslD4    (55)  TVHIPPTPDNQPMAT------------KAEEQYVSNSLFTGGFNSVTRA
OsCslD3    (68)  TVQIPPTPDNQPMLNGAEPA----SVAMKAEEQYVSNSLFTGGFNSATRA
AtCslD5    (93)  TVHIPPTPDHQTVFASQESEEDEMLKGNSNQKSFLSGTIFTGGFKSVTRG
AtCslD6    (33)  LVQIPPTPDNNPGPAS---------------------------------L
OsCslF7     (1)  --------------------------------------------------
OsCslF1     (1)  --------------------------------------------------
OsCslF2     (1)  --------------------------------------------------
OsCslF4     (1)  --------------------------------------------------
OsCslF3     (1)  --------------------------------------------------
AtCslB1     (1)  --------------------------------------------------
```

Figure 5E

```
AtCslB2    (1)  ------------------------------------------------
AtCslB4    (1)  ------------------------------------------------
AtCslB3    (1)  ------------------------------------------------
AtCslB5    (1)  ------------------------------------------------
AtCslB6    (1)  ------------------------------------------------
OsCslH1    (1)  ------------------------------------------------
OsCslH2    (1)  ------------------------------------------------
AtCslE1    (1)  ------------------------------------------------
OsCslE1    (1)  ------------------------------------------------
OsCslE5    (1)  ------------------------------------------------
AtCslG1    (1)  ------------------------------------------------
AtCslG2    (1)  ------------------------------------------------
AtCslG3    (1)  ------------------------------------------------
AtCslC12   (1)  -----------------------------------------------M
OsCslC1    (1)  ------------------------------------------------
OsCslC7    (1)  ------------------------------------------------
OsCslC9    (1)  ------------------------------------------------
AtCslC5    (1)  ----------------------------------------------MA
AtCslC8    (1)  ----------------------------------------------MA
OsCslC3    (1)  --------------------------------------------MAPP
OsCslC2    (1)  -------------------------------------------MAPPG
AtCslC4    (1)  ------------------------------------------------
AtCslC6    (1)  --------------------------------------------MSRS
OsCslA8    (1)  ------------------------------------------------
OsCslA2    (1)  ------------------------------------------------
OsCslA4    (1)  ------------------------------------------------
OsCslA5    (1)  ------------------------------------------------
OsCslA7    (1)  ------------------------------------------------
OsCslA3    (1)  ------------------------------------------------
OsCslA11   (1)  ------------------------------------------------
OsCslA6    (1)  ------------------------------------------------
AtCslA1    (1)  ------------------------------------------------
AtCslA10   (1)  ------------------------------------------------
AtCslA15   (1)  ------------------------------------------------
AtCslA11   (1)  ------------------------------------------------
AtCslA14   (1)  ------------------------------------------------
AtCslA3    (1)  ------------------------------------------------
AtCslA7    (1)  ------------------------------------------------
AtCslA2    (1)  ------------------------------------------------
PoXylS     (1)  ------------------------------------------------
OsCslA1    (1)  ------------------------------------------------
OsCslA9    (1)  ------------------------------------------------
AtCslA9    (1)  ------------------------------------------------
PtCslA1    (1)  ------------------------------------------------
PtCslA2    (1)  ------------------------------------------------
CtManS     (1)  ------------------------------------------------
PpCslA1    (1)  ------------------------------------------------
Consensus (101)
                151                                          200
AtCesA1  (101)  EDEDDVDDIENEFNYAQGANK-----ARHQRHGEEFSSSS-RHESQP---
AtCesA10  (95)  EKEDDVNDIENEFDYTQGNNK-----ARLPHRAEEFSSSSRHEESLP---
ZmCesA1  (103)  EDEEDVDDLDNEFNYKQGSGKGPEWQLQG--DDADLSSSARHEPHHR---
ZmCesA2  (103)  DEEEDVDDLDNEFNYKQGNGKGPEWQLQG--DDADLSSSARHDPHHR---
ZmCesA3  (100)  EEEDGVDDLDNEFNYTQGNVQGPQWQLQGQGEDVDISSSSRHEPHHR---
```

Figure 5F

```
AtCesA2   (101)  DEEEEDIDDLEYEFDHGMDP----------EHAAEAALSSRLNTGR----
AtCesA9   (101)  EEDD-DIDDLEHEFYGMDPE----------HVTEAALYYMRLNTGRGTD-
AtCesA5   (101)  EEDD-GIDDLDFEFDYSRS--------------GLESETFSRRNS---
AtCesA6   (101)  EEED-DIDDLDNEFEYGNNG----------IGFDQVSEGMSISRRNSGF-
ZmCesA6    (71)  EEED-GVDDLENEFNWSDK----H----DSQYLAESMLHAHMSYGRGAD-
ZmCesA7   (101)  EEED-GVDDLDNEFNWDG-----H----DSQSVAESMLYGHMSYGRGGD-
ZmCesA8   (103)  EEED-GVDDLEGEFGLQDGAAHED----DPQYVAESMLRAQMSYGRG---
AtCesA3    (82)  KDEDGLAD----EG-TVEFNYPQK------EKISERMLGWHLTRGKG---
ZmCesA4    (81)  EGDDTDAD--SDFNYLASGNEDQK------QKIADRMRSWRMNVGGSGDV
ZmCesA9    (81)  EGDDTDADDASDFNYPASGNDDQK------QKIADRMRSWRMNAGGSGDV
ZmCesA5    (80)  ENEDVDADDVSDYNYQASGNQDQK------QKIAERMLTWRTNSRGS-DI
AtCesA7    (99)  EDEEDIDDIEYEFNIEHE-------QDK-HKHSAEAMLYGKMSYGRG---
ZmCesA12   (99)  DDEEDIDDLEHEFNIDDENQQRQLEGNMQNSQITEAMLHGRMSYGRG---
ZmCesA13   (99)  DDEEDIDDLEHEFNIDDE-KQRQLEGNMQNSQITEAMLHGKMSYGRG---
AtCesA4    (67)  --------------------------------------VSLSH--
ZmCesA10  (103)  EEEGPEMDDFEDEF---------------------------PAKSPK--
AtCesA8    (57)  PYDENVFDDVETKTS---------------------KTQS--IVPT---
ZmCesA11   (64)  EAEEEVVENHHTAGG---------------------LRER--VTMG---
AtCslD1    (76)  ---------------------GSTSESKGDAN---RGGG---------
AtCslD2   (105)  HLMHKVIETEPNHPQMAGSKGSSCAIPGCDAKVMSDERGQDLLPCECDFK
AtCslD3   (107)  HLMEKVIDTETSHPQMAGAKGSSCAVPGCDVKVMSDERGQDLLPCECDFK
OsCslD2   (123)  HLMDKVIESEASHPQMAGAKGSSCAINGCDAKVMSDERGDDILPCECDFK
OsCslD1    (95)  HVMEKQASSAR-----AT--VSACMVQGCGSKIMRNGRGADILPCECDFK
AtCslD4    (92)  HLMDKVIDSDVTHPQMAGAKGSSCAMPACDGNVMKDERGKDVMPCECRFK
OsCslD3   (114)  HLMDKVIESSVSHPQMAGAKGSRCAMPACDGSAMRNERGEDVDPCECHFK
AtCslD5   (143)  HVIDCSMDRADPEKK---S-GQICWLKGCDEKVVHG-------RCECGFR
AtCslD6    (50)  SIVLLEIDSNQ-E--------S---VPSVSGDIVSGSSG-----------
OsCslF7     (1)  --------------------------------------------------
OsCslF1     (1)  --------------------------------------------------
OsCslF2     (1)  --------------------------------------------------
OsCslF4     (1)  --------------------------------------------------
OsCslF3     (1)  --------------------------------------------------
AtCslB1     (1)  --------------------------------------------------
AtCslB2     (1)  --------------------------------------------------
AtCslB4     (1)  --------------------------------------------------
AtCslB3     (1)  --------------------------------------------------
AtCslB5     (1)  --------------------------------------------------
AtCslB6     (1)  --------------------------------------------------
OsCslH1     (1)  --------------------------------------------------
OsCslH2     (1)  --------------------------------------------------
AtCslE1     (1)  --------------------------------------------------
OsCslE1     (1)  --------------------------------------------------
OsCslE5     (1)  --------------------------------------------------
AtCslG1     (1)  --------------------------------------------------
AtCslG2     (1)  --------------------------------------------------
AtCslG3     (1)  --------------------------------------------------
AtCslC12    (2)  APKFEWWAKGNNNNTRKGTPVVVKMENPN-NWSMVELESPSHDDF-----
OsCslC1     (1)  --MARWWG--GEGRGGSGTPVVVKMESPE-WAISEVEAGAAAPGS-----
OsCslC7     (1)  --------------------------------------------------
OsCslC9     (1)  --------------------------------------------------
AtCslC5     (3)  PRLDFSDWWAKDT--RKGTPVVVKMENPN-YSVVEIDGPDSAFRP-----
AtCslC8     (3)  PRFDFSDLWAKET--RRGTPVVVKMENPN-YSIVEVEEPDSAFQP-----
OsCslC3     (5)  PNTYSESWWGGKE--ERGTPVVVKMDNP--YSLVEIDGPGMAAP------
OsCslC2     (6)  VGVGVAYLWGKGRGGRKGTPVVVTMESPN-YSVVEVDGPDAEAELRTAAV
```

Figure 5G

```
    AtCslC4    (1)  ---------------MAPNSVAVTMEKPDNFSLLEINGSDPSSFP-----
    AtCslC6    (5)  QNEEFQQWWNKQR--DRNNHDVLYAGDDEAFLTVEIRTPATVDPD-----
    OsCslA8    (1)  --------------------------------------------------
    OsCslA2    (1)  --------------------------------------------------
    OsCslA4    (1)  --------------------------------------------------
    OsCslA5    (1)  --------------------------------------------------
    OsCslA7    (1)  --------------------------------------------------
    OsCslA3    (1)  --------------------------------------------------
   OsCslA11    (1)  --------------------------------------------------
    OsCslA6    (1)  --------------------------------------------------
    AtCslA1    (1)  --------------------------------------------------
   AtCslA10    (1)  --------------------------------------------------
   AtCslA15    (1)  --------------------------------------------------
   AtCslA11    (1)  --------------------------------------------------
   AtCslA14    (1)  --------------------------------------------------
    AtCslA3    (1)  --------------------------------------------------
    AtCslA7    (1)  --------------------------------------------------
    AtCslA2    (1)  --------------------------------------------------
     PoXylS    (1)  --------------------------------------------------
    OsCslA1    (1)  --------------------------------------------------
    OsCslA9    (1)  --------------------------------------------------
    AtCslA9    (1)  --------------------------------------------------
    PtCslA1    (1)  --------------------------------------------------
    PtCslA2    (1)  --------------------------------------------------
     CtManS    (1)  --------------------------------------------------
    PpCslA1    (1)  --------------------------------------------------
  Consensus  (151)
                   201                                              250
    AtCesA1  (142)  ----------IPLLTHGHTVSGEIRTPDTQSVRTTSGPLGPSDRNAISS
   AtCesA10  (137)  ----------VSLLTHGHPVSGEIPTP--------------DRNATLS
    ZmCesA1  (148)  ----------IPRLTSGQQISGEIPDASPDR----------HSIRSPTS
    ZmCesA2  (148)  ----------IPRLTSGQQISGEIPDASPDR----------HSIRSPTS
    ZmCesA3  (147)  ----------IPRLTTGQQMSGDIPDASPDR----------HSIRSPTP
    AtCesA2  (137)  -----------GGLDSAPPGSQIPLLTYCDEDADMY--------SDRH
    AtCesA9  (139)  ----------EVSHLYSASPGSEVPLLTYCDEDSDMY--------SDRH
    AtCesA5  (131)  -----------EFDLASAPPGSQIPLLTYGEEDVEIS--------SDSH
    AtCesA6  (139)  ----------PQSDLDSAPPGSQIPLLTYGDEDVEIS--------SDRH
    ZmCesA6  (111)  ----------LDGVPQPFHPIPNVPLLTNGQMVDDIP--------PDQH
    ZmCesA7  (140)  ----------PNGAPQAFQLNPNVPLLTNGQMVDDIP--------PEQH
    ZmCesA8  (145)  -----------GDAHPGFSPVPNVPLLTNGQMVDDIP--------PEQH
    AtCesA3  (118)  -------EEMGEPQYDKEVSHNHLPRLTSRQDTS------GEFSAASPER
    ZmCesA4  (123)  GRPKYDSGEIGLTKYDSGEIPRGYIPSVTNSQIS------GEIPGASPDH
    ZmCesA9  (125)  GRPKYDSGEIGLTKYDSGEIPRGYIPSVTNSQIS------GEIPGASPDH
    ZmCesA5  (123)  GLAKYDSGEIGHGKYDSGEIPRGYIPSLTHSQIS------GEIPGASPDH
    AtCesA7  (138)  ----------PEDDENG-----RFPPVIAGG----------HSGEFPVG
   ZmCesA12  (146)  ----------PDDGDNNTP--QIPPIITGSRS------VPVSGEFPIT
   ZmCesA13  (145)  ----------ADDGEGNNTP--QMPPIITGARS------VPVSGEFPIT
    AtCesA4   (72)  ---------------LDQILSIFSVMQENGD----------------Y
   ZmCesA10  (123)  ---------------KPHEPVAFDVYSENGE----------------H
    AtCesA8   (80)  -----------------QTNNTSQDSGIHAR-----------------
   ZmCesA11   (87)  -----------------SHLNDRQDEVSHAR-----------------
    AtCslD1   (91)  --------G------------------------------GDG
    AtCslD2  (155)  ICRDCFIDAVKTGGGICPGCKEPYKNTHLTDQVDEN-----GQQRPMLPG
    AtCslD3  (157)  ICRDCFMDAVKTGG-MCPGCKEPYRNTDLADFADNN-----KQQRPMLPP
```

Figure 5H

```
OsCslD2   (173) ICADCFADAVKNGG-ACPGCKDPYKATELDDVVGARP----TLSLPPPPG
OsCslD1   (138) ICVDCFTDAVKGGGGVCPGCKEPYKHAEWEEVVSASNHDAINRALSLPHG
AtCslD4   (142) ICRDCFMDAQKETG-LCPGCKEQYKIGDLDDDTPDYS----SGALPLPAP
OsCslD3   (164) ICRDCYLDAQKDGC-ICPGCKEHYKIGEYADDDPHDG----KLHLPGPGG
AtCslD5   (182) ICRDCYFDCITSGGGNCPGCKEPYRDINDDPETEEEDEEDEAKPLPQMGE
AtCslD6    (77) ------K-------------------------------------------
OsCslF7    (1) --------------------------------------------------
OsCslF1    (1) -----------------------------------------------MSA
OsCslF2    (1) ---------------------------------------MAATAASTMSA
OsCslF4    (1) -----------------------------------------------MSA
OsCslF3    (1) -----------------------------------------------MAS
AtCslB1    (1) --------------------------------------------------
AtCslB2    (1) --------------------------------------------------
AtCslB4    (1) --------------------------------------------------
AtCslB3    (1) --------------------------------------------------
AtCslB5    (1) --------------------------------------------------
AtCslB6    (1) --------------------------------------------------
OsCslH1    (1) --------------------------------------------------
OsCslH2    (1) --------------------------------------------------
AtCslE1    (1) --------------------------------------------------
OsCslE1    (1) --------------------------------------------------
OsCslE5    (1) --------------------------------------------------
AtCslG1    (1) --------------------------------------------------
AtCslG2    (1) --------------------------------------------------
AtCslG3    (1) --------------------------------------------------
AtCslC12  (46) ---LVRTHEKSRNKNARQLTWVLLLKAHRAAGCLTSLGSALFALGTAVRR
OsCslC1   (41) ---PAAGGKAGRGKNARQITWVLLLKAHRAAGKLTGAASAALSVAAAARR
OsCslC7    (1) --------------------------------------------------
OsCslC9    (1) --------------------------------------------------
AtCslC5   (45) -------VEKSRGKNAKQVTWVLLLKAHRAVGCLTWLATVFWSLLGAIKK
AtCslC8   (45) -------MEKSRGKNAKQVTWVLLLKAHKAVGCLTWVATVFWSLLGSVKR
OsCslC3   (45) -------SEKARGKNAKQLTWVLLLRAHRAVGCVAWLAAGFWAVLGAVNR
OsCslC2   (55) AMDKGGGRGRSRSRTARQLTWVLLLRARRAAGRLASFAA----AA---AR
AtCslC4   (31) --------DKRKSISPKQFSWFLLLKAHRLISCLSWLVS----SVKKRIA
AtCslC6   (48) -------KDRIRTRTVRQLSRLYLLKFKQLASSFLWIGNSFLYLVRTANR
OsCslA8    (1) --------------------------------------------------
OsCslA2    (1) --------------------------------------------------
OsCslA4    (1) --------------------------------------------------
OsCslA5    (1) --------------------------------------------------
OsCslA7    (1) --------------------------------------------------
OsCslA3    (1) --------------------------------------------------
OsCslA11   (1) --------------------------------------------------
OsCslA6    (1) --------------------------------------------------
AtCslA1    (1) --------------------------------------------------
AtCslA10   (1) --------------------------------------------------
AtCslA15   (1) --------------------------------------------------
AtCslA11   (1) --------------------------------------------------
AtCslA14   (1) --------------------------------------------------
AtCslA3    (1) --------------------------------------------------
AtCslA7    (1) --------------------------------------------------
AtCslA2    (1) --------------------------------------------------
PoXylS     (1) --------------------------------------------------
OsCslA1    (1) --------------------------------------------------
OsCslA9    (1) --------------------------------------------------
```

Figure 5I

```
   AtCslA9      (1)  ------------------------------------------------
   PtCslA1      (1)  ------------------------------------------------
   PtCslA2      (1)  ------------------------------------------------
    CtManS      (1)  ------------------------------------------------
   PpCslA1      (1)  ------------------------------------------------
 Consensus    (201)
                    251                                            300
   AtCesA1    (181)  PYIDPRQP--------------------VPVRIVDPSKDLNSYGLGNVDW
  AtCesA10    (161)  PCIDPQLPGI------------YQLLLLPVRILDPSKDLNSYGLVNVDW
   ZmCesA1    (177)  SYVDPSVP--------------------VPVRIVDPSKDLNSYGLNSVDW
   ZmCesA2    (177)  SYVDPSVP--------------------VPVRIVDPSKDLNSYGLNSVDW
   ZmCesA3    (176)  SYVDPSIP--------------------VPVRIVDPSKDLNSYGVGSVDW
   AtCesA2    (166)  ALIVPPSTG---YGNRVYPAPFTDSSAPPQARSMVPQKDIAEYGYGSVAW
   AtCesA9    (170)  ALIVPPSTG---LGNRVHHVPFTDSFASIHTRPMVPQKDLTVYGYGSVAW
   AtCesA5    (161)  ALIVSPSPG---HIHRVHQPHFPDP--AAHPRPMVPQKDLAVYGYGSVAW
   AtCesA6    (170)  ALIVPPSLGG--HGNRVHPVSLSDPTVAAHPRPMVPQKDLAVYGYGSVAW
   ZmCesA6    (142)  ALVPSFVGGGG---KRIHPLPYADPNLPVQPRSMDPSKDLAAYGYGSVAW
   ZmCesA7    (171)  ALVPSFMGGGG---KRIHPLPYADPSLPVQPRSMDPSKDLAAYGYGSVAW
   ZmCesA8    (175)  ALVPSYMSGGGGGGKRIHPLPFADPNLPVQPRSMDPSKDLAAYGYGSVAW
   AtCesA3    (155)  LSVSSTIAGGK-----------RLPYSSDVNQSPNRRIVDPVGLGNVAW
   ZmCesA4    (167)  HMMSPTGNIG------------KRAPFPYVNHSPNPSREFSGSIGNVAW
   ZmCesA9    (169)  HMMSPTGNIG------------RRAPFPYMNHSSNPSREFSGSVGNVAW
   ZmCesA5    (167)  MMSPVGNIGR------------RGHQFPYVNHSPNPSREFSGSLGNVAW
   AtCesA7    (162)  GGYGNGEHG--------------LHKRVHPYPSSEAG-----S--EGGW
  ZmCesA12    (177)  NGYGHGEVSS------------SLHKRIHPYPVSEPGSAKWDEKKEVSW
  ZmCesA13    (176)  NGYGHGELSS------------SLHKRIHPYPVSEPGSAKWDEKKEVSW
   AtCesA4     (89)  NSKQQWRPNG------------RAFSSTGSVLGKDFEAERDGYTDAEW
  ZmCesA10    (140)  PAQKWRTGGQ------------TLSSFTGSVAGKDLEAEREMEGSMEW
   AtCesA8     (94)  ------------------------------HISTVSTIDSELNDEYGNPIW
  ZmCesA11    (101)  ------------------------------TMSSLSGIGSELNDESGKPIW
   AtCslD1     (95)  PKMGNKLERRLSVMKSNNKSMLLRSQTGDFDHNRWLFESKGKYGIGNAFW
   AtCslD2    (200)  GGG-SKMERRLSMVKSTNKSALMRSQTGDFDHNRWLFETTGTYGYGNAFW
   AtCslD3    (201)  PAGGSKMDRRLSLMKST-KSGLMRSQTGDFDHNRWLFETSGTYGFGNAFW
   OsCslD2    (218)  GLPASRMERRLSIMRSQ--KAMTRSQTGDWDHNRWLFETKGTYGYGNAIW
   OsCslD1    (188)  HGHGPKMERRLSLVKQN---GGAP---GEFDHNRWLFETKGTYGYGNAIW
   AtCslD4    (187)  GKDQRGNNNNMSMMKRN--------QNGEFDHNRWLFETQGTYGYGNAYW
   OsCslD3    (209)  GGNK-------SLLARN--------QNGEFDHNRWLFESSGTYGYGNAFW
   AtCslD5    (232)  SKLDKRLSVVKSFKAQN--------QAGDFDHTRWLFETKGTYGYGNAVW
   AtCslD6     (78)  ---------------------------DNEPDLTDVRINVGE-----
   OsCslF7      (1)  -------------------------MPPSAGLATESLPAATCPAKK
   OsCslF1      (4)  AAAVTS--------------------WTNGCWSPAATRVNDGG----K
   OsCslF2     (12)  AAAVTRRINAALRVDATSGD--VAAGADGQNGRRSPVAKRVNDGGGG--K
   OsCslF4      (4)  AAVTRRINAGGLRVEVTNGNGAAGVYVAAAAAPCSPAAKRVNDGGG---K
   OsCslF3      (4)  PASVAGGGE-----DSNGCSSLIDPLLVSRTSSIGGAERKAAGGGGGGAK
   AtCslB1      (1)  ------------------------------------------------
   AtCslB2      (1)  ------------------------------------------------
   AtCslB4      (1)  ------------------------------------------------
   AtCslB3      (1)  ------------------------------------------------
   AtCslB5      (1)  ------------------------------------------------
   AtCslB6      (1)  ------------------------------------------------
   OsCslH1      (1)  ------------------------------------------------
   OsCslH2      (1)  ------------------------------------------------
   AtCslE1      (1)  ------------------------------------------------
   OsCslE1      (1)  ------------------------------------------------
```

Figure 5J

```
OsCslE5     (1)   ------------------------------------------------
AtCslG1     (1)   ------------------------------------------------
AtCslG2     (1)   ------------------------------------------------
AtCslG3     (1)   ------------------------------------------------
AtCslC12   (93)   RIAAGRTDIEISSSGVGSLQKQNHTKKSKLFYSCLKVFLWLSLILLGFEI
OsCslC1    (88)   RVAAGRTDSDDAAAAPPGESPALRAR----FHGFLRAFLLLSVLLLAVDV
OsCslC7     (1)   -------------------------------YGCIRVSLVLSLLLLAVEV
OsCslC9     (1)   ---MAPWSGLWGGKLAAGESPVLRSR----FYAFIRAFVVLSVLLLIVEL
AtCslC5    (88)   RLSFTHPLGSE-----------KLGRDRWLFTAIKLFLAVSLVILGFEI
AtCslC8    (88)   RLSFTHPLGSE-----------RLGRDGWLFSAIKLFLVASLAILAFEL
OsCslC3    (88)   RVRRSRDADAEPDAE--------ASGRGRAMLRFLRGFLLLSLAMLAFET
OsCslC2    (98)   RFRRSPADAADELG---------RGRGRLMYGFIRGFLALSLLALAVEL
AtCslC4    (69)   FSAKNINEEEDP-----------KSRGKQMYRFIKACLVISIIALSIEI
AtCslC6    (91)   RIANDNPPSVSSSAR---------------LYRLIKGFLVVVVLLLCFEL
OsCslA8     (1)   ------------------------------------------------
OsCslA2     (1)   ------------------------------------------------
OsCslA4     (1)   ------------------------------------------------
OsCslA5     (1)   -----MEAGEAAGAVLFLLAAAVSLLAAVSTGALDFTYLVTVVGEG----
OsCslA7     (1)   ----MVEAGEIGGAAVFALAAAAALSAASSLGAVDFRRPLAAVGGGGAFE
OsCslA3     (1)   ----------------MAMAGADGPTAGAAAAVRWR-------------
OsCslA11    (1)   ----------------------------------------------MSS
OsCslA6     (1)   ------------------------------------------------
AtCslA1     (1)   ------------------------------------------------
AtCslA10    (1)   ---------------------------MTTFLKSLIFLQDSCLAFLS
AtCslA15    (1)   ---------------------------MFLLLKPLLSLHDLSLNLLS
AtCslA11    (1)   ------------------------------------------------
AtCslA14    (1)   ------------------------------------------------
AtCslA3     (1)   ---------------------------MSPFLKFFLFLYDYLSPSSF
AtCslA7     (1)   ---------------------------MSPLPIFHRLPHATFSSFLL
AtCslA2     (1)   ------------------------------------------------
PoXylS      (1)   ------------------------------------------------
OsCslA1     (1)   ------------------------------------------------
OsCslA9     (1)   ------------------------------------------------
AtCslA9     (1)   ------------------------------------------------
PtCslA1     (1)   ------------------------------------------------
PtCslA2     (1)   ------------------------------------------------
CtManS      (1)   ------------------------------------------------
PpCslA1     (1)   ------------------------------------------------
Consensus (251)
                  301                                              350
AtCesA1   (211)   KERVEGWKLKQEK------NMLQMTGKYHEGKGGEI--EGTGSNGEELQM
AtCesA10  (198)   KKRIQGWKLKQDK------NMIHMTGKYHEGKGGEF--EGTGSNGDELQM
ZmCesA1   (207)   KERVESWRVKQDK------NMMQVTNKYPEARGGDM--EGTGSNGEXMQM
ZmCesA2   (207)   KERVESWRVKQDK------NMLQVTNKYPEARG-DM--EGTGSNGEDMQM
ZmCesA3   (206)   KERVESWKVRQDK------NMIQVTHKYPAEGKGDI--EGTGSK-----W
AtCesA2   (213)   KDRMEVWKRRQG-------EKLQVIKHEGGNNGRGS-NDDDELDDPDMPM
AtCesA9   (217)   KDRMEVWKKQQI-------EKLQVVKNERVNDGDGDGFIVDELDDPGLPM
AtCesA5   (206)   KDRMEEWKRKQN-------EKYQVVKHDGDSSLGDG-------DDADIPM
AtCesA6   (218)   KDRMEEWKRKQN-------EKLQVVRHEGDPDFEDG-------DDADFPM
ZmCesA6   (189)   KERMESWKQKQ--------ERMHQTRNDGG---------GDDGDDADLPL
ZmCesA7   (218)   KERMENWKQRQ--------ERMHQTGNDGG---------GDDGDDADLPL
ZmCesA8   (225)   KERMEGWKQKQ--------ERLQHVRSEGGG--------DWDGDDADLPL
AtCesA3   (193)   KERVDGWKMKQEKNTGPVSTQAASE----RGGVDID--ASTDILADEALL
ZmCesA4   (204)   KERVDGWKMKQDKGTIPMTNGTSIAPSEGRGVGDID--ASTDYNMEDALL
```

Figure 5K

```
ZmCesA9   (206) KERVDGWKMKQDKGTIPMTNGTSIAPSEGRGVGDID--ASTDYNMEDALL
ZmCesA5   (204) KERVDGWKMK-DKGAIPMTNGTSIAPSEGRGVADID--ASTDYNMEDALL
AtCesA7   (190) RERMDDWKLQ-----------------HGNLGPE------PDDDPEMGL
ZmCesA12  (214) KERMDDWKSK-----------------QGILGGG---ADPEDMDADVAL
ZmCesA13  (213) KERMDDWKSK-----------------QGILGGGG--GDPEDMDADVPL
AtCesA4   (125) KERVDKWKARQEK--------------RGLVTKGEQTNEDKEDDEEEYL
ZmCesA10  (176) KDRIDKWKTKQEK--------------RGKLNHDDSDDDDDKNEDEYML
AtCesA8   (115) KNRVESWKDKKDKKS---KKKKKDPKATKAEQQDAQVPTQQHMEDMPPNT
ZmCesA11  (122) KNRVESWKEKKN-------EKKASAKKTAAKAQ----PPPVEEQIMDEKD
AtCslD1   (145) SEEDDTYDG---------------------------GVSKSDF
AtCslD2   (249) TKDGDFGSGKDG--D--------------------GDGDGMGMEAQDL
AtCslD3   (250) TKDGNFGS------D--------------------KDGNGHGMGPQDL
OsCslD2   (266) PKENEVDNGGGGGGG---------------------GGLGGGDGQPAEF
OsCslD1   (232) PEDDGVAG----------------------------------HPKEL
AtCslD4   (229) PQDEMYGDDMDEGMR---------------------------GGMVET
OsCslD3   (244) PKGGMYDDDLDDDVDKL-----------------GGDGGGGGGGGPLP
AtCslD5   (274) PKDGYGIGS-------------------------GGGGNGYETPPEF
AtCslD6   (93)  ----E--E---------------------------------EDDTL
OsCslF7   (22)  DAYAAAASP--------------------------------ESETKLA
OsCslF1   (28)  DDVWVAVD---------------------------------EADVSGARGS
OsCslF2   (58)  DDVWVAVD---------------------------------EKDVCGARGG
OsCslF4   (51)  DDVWVAVD---------------------------------EADVSGPSGG
OsCslF3   (49)  GKHWAAADK--------------------------------GERRAAKECGG
AtCslB1   (1)   ----------------------------------------
AtCslB2   (1)   ---------------------------------------MAE
AtCslB4   (1)   ---------------------------------------MAD
AtCslB3   (1)   ---------------------------------------MAD
AtCslB5   (1)   ---------------------------------------MAD
AtCslB6   (1)   ---------------------------------------MAD
OsCslH1   (1)   -------------------------------------MEAAARGN
OsCslH2   (1)   -------------------MAVVAAAAATGSTTRSGGGGGEGTRSGR
AtCslE1   (1)   ---------------------------------------MVNKDDRIRP
OsCslE1   (1)   ----------------------------------------METTAA
OsCslE5   (1)   -----------------------------------------------
AtCslG1   (1)   ---------------------------------------------METH
AtCslG2   (1)   ---------------------------------------------MEPQ
AtCslG3   (1)   ---------------------------------------------MEPH
AtCslC12  (143) AAYFKGWSFGT------------------------------------
OsCslC1   (134) AAHAQGWH----------------------------------------
OsCslC7   (20)  AAYLQGWHL---------------------------------------
OsCslC9   (44)  GAYINGWDD---------------------------------------
AtCslC5   (126) VAYFRGWHYFQSPS----------------------------------
AtCslC8   (126) VAYYRGWHYFKNPN----------------------------------
OsCslC3   (130) VAHLKGWHFPRSAAGLP-----EKYLRRLPEHLQHL-------PEHLRRH
OsCslC2   (138) AAYWNGWRLRR-PE----------------------------------
AtCslC4   (107) VAHFKKWNLDLIN-----------------------------------
AtCslC6   (126) AAYFKGWHFT--------------------------------------
OsCslA8   (1)   ------------------------------------------------
OsCslA2   (1)   ------------------------------------------------
OsCslA4   (1)   -------MEGQWGR----------------------------------
OsCslA5   (42)  ------------------------------------------------
OsCslA7   (47)  WDGVVPWLIGVLGG----------------------------------
OsCslA3   (21)  -----------GG-----------------------------------
OsCslA11  (4)   SGGGGVAEEVARLW----------------------------------
```

Figure 5L

```
OsCslA6    (1)   ---MQGDLALRAGG----------------------------------------
AtCslA1    (1)   ------------------------------------------------------
AtCslA10  (21)   LMFHRGSSEDAAEA----------------------------------------
AtCslA15  (21)   VMFHG-------------------------------------------------
AtCslA11   (1)   ------------------------------------------------------
AtCslA14   (1)   -------------MA---------------------------------------
AtCslA3   (21)   FLVQRNTLG---AS----------------------------------------
AtCslA7   (21)   SLSQAGSSK---TS----------------------------------------
AtCslA2    (1)   ---MDGVS--PKFV----------------------------------------
PoXylS     (1)   ---MAEVS--GKSF----------------------------------------
OsCslA1    (1)   ------------------------------------------------------
OsCslA9    (1)   ------------------------------------------------------
AtCslA9    (1)   ----MELG-DTTSV----------------------------------------
PtCslA1    (1)   ---MDRLS--SANL----------------------------------------
PtCslA2    (1)   ---MDRLSYSSANI----------------------------------------
CtManS     (1)   ----------MRNL----------------------------------------
PpCslA1    (1)   -------------M----------------------------------------
Consensus (301)
                 351                                                400
AtCesA1   (253)  ADDTRLPMSRVVPIPSSRLTPYRVVIILRDIILCFFLQYRTTHPVK----
AtCesA10  (240)  VDDARLPMSRVVHFPSARMTPYRIVIVLRLILGVFLHYRTTHPVK----
ZmCesA1   (249)  VDDARLPLSRIVPISSNQLNLYRVVIILRLIILCFFFQYRVSHPVR----
ZmCesA2   (248)  VDDARLPLSRIVPISSNQLNLYRIVIILRLIILCFFFQYPISHPVR----
ZmCesA3   (243)  ADDARLPLSRIVPISPNELNLYRIVEVLRLIILCFFFQYRITHPVE----
AtCesA2   (255)  MDEGRQPLSRKLPIRSSRINPYRMLILCRLAIIGLFFHYRILHPVN----
AtCesA9   (260)  MDEGRQPLSRKLPIRSSRINPYRMLIFCRLAIIGLFFHYRILHPVN----
AtCesA5   (242)  MDEGRQPLSRKVPIKSSKINPYRMLIVLRLVIIGLFFHYRILHPVN----
AtCesA6   (254)  MDEGRQPLSRKLPIKSSKINPYRMLIVLRLVIIGLFFHYRILHPVK----
ZmCesA6   (222)  MDEARQPLSRKLPIPSSQINPYRMITIIRLVVLCFFFHYRVMHPVP----
ZmCesA7   (251)  MDEARQQLSRKLPIPSSQINPYRMITIIRLVVLGFFFHYRVMHPVN----
ZmCesA8   (259)  MDEARQPLSRKVPISSSRINPYRMITVIRLVVLGFFFHYRVMHPAK----
AtCesA3   (237)  NDEARQPLSRKVSIPSSRINPYRMVIMLRLVTICLFLHYRITNPVP----
ZmCesA4   (252)  NDETRQPLSRKVPLPSSRINPYRVVIVLRLIVLSIFLHYRITNPVR----
ZmCesA9   (254)  NDETRQPLSRKVPLPSSRINPYRVVIVLRLIVLSIFLHYRITNPVR----
ZmCesA5   (251)  NDETRQPLSRKVPIPSSRINPYRMVIVLRLAVICIFLRYRITHPVN----
AtCesA7   (216)  IDEARQPLSRKVPIASSKINPYRMVIVARLVILAVFLRYRILNPVH----
ZmCesA12  (243)  NDEARQPLSRKVSIASSKVNPYRMVIVVRLILAFFLRYRILHPVP----
ZmCesA13  (243)  NDEARQPLSRKVSIASSKVNPYRMVIVVRLILAFFLRYRILHPVP----
AtCesA4   (160)  DAEARQPLWRKVPISSSKISPYRIVIVLRLVLVFFFRFRILTPAK----
ZmCesA10  (211)  LAEARQPLWRKVPIPSSMINPYRIVIVLRIVVICFFLKFRITTPAT----
AtCesA8   (162)  ESGATDVLSVVLPIPRTKITSYRIVIIMRLILALFFNYRITHPVD----
ZmCesA11  (161)  LTDAYEPLSRVVPISKNKLTPVRAVIIMRLIVLGLFFHYRITNPVN----
AtCslD1   (161)  LDKPWKPLTRKVQIPAKILSPYRLLVIRLVIVFFFLWWRITNPN-----
AtCslD2   (275)  MSRPWRPLTRKLKIPAGVISPYRLLIERIVVLALFLTWRVKHQN-----
AtCslD3   (272)  MSRPWRPLTRKLQIPAAVISPYRLLILIRIVVLALFLMWRIKHKN-----
OsCslD2   (294)  TSKPWRPLTRKLKIPAGVLSPYRLLILIRMAVLGLFLAWRIKHKN-----
OsCslD1   (245)  MSKPWRPLTRKLRIQAAVISPYRLLVLIRLVALGLFLMWRIKHQN-----
AtCslD4   (250)  ADKPWRPLSRRLPIPAAIISPYRLLIVIRFVVLCFFLTWRIRNPN-----
OsCslD3   (275)  EQKPFKPLTRKLPMPTSVISPYRIFTVIRMFVLLFYLTWRIRNPN-----
AtCslD5   (296)  GERSKRPLTRKVSVSAAIISPYRLLIALRLVALGLFLTWRVRHPN-----
AtCslD6   (100)  LSKISYSLTRVVKISPIIIALYRILIVVRVVSLALFLFWRIRNPN-----
OsCslF7    (38)  AGDERAPLVRTTRISTTTIKLYRITIEVRIALFVLFFKWRITYAARAISS
OsCslF1    (46)  DGGGRPPLFQTYKVKGSILHPYFLILARLIALVAFFAWRIRHKN-----
OsCslF2    (76)  DGAARPPLFRTYKVKGSILHPYRFLILLRLIALVAFFAWRVRHKN-----
```

Figure 5M

```
OsCslF4     (69) DG-VRPTLFRTYKVKGSILHPYRVLDPSSTDRHRRFFAWRVRHKN-----
OsCslF3     (69) EDGRRPLIFRSYRVKGSLLHPYRALIFARLIAVLLFFGWRIRHNN-----
AtCslB1      (1) ----------------------------------------------MNQ----
AtCslB2      (4) SSSPLPPLCERISHKS---YFLRAVDITILGLLLSLLLYRILHVNQ----
AtCslB4      (4) SSCSLPPLYENISYKS---YILRAVDITILGLLFSLLLHRILYMSQ----
AtCslB3      (4) SSFSLPPLCERISYTN---YFLRAVYLTVLGLFFSLLLHRIRHTSE----
AtCslB5      (4) SSSSLHPLCERISHKS---YVLRAVDLTILGLLYSLLLYRILHISE----
AtCslB6      (4) SSSSLLPLCERISHKS---YILRIVDLTILVLLFSLLWYRILHMCE----
OsCslH1      (9) KK-----LQERVPLRR---TAWRLADLAIIFLLLALLLHRVLHDSG----
OsCslH2     (29) KKPPPPPLQERVPLGRRAAWAWRLAGLAVLLLLLALLALRILRHHGGA--
AtCslE1     (11) VHEADGEPLFETRRRTGRVIAYRFFSASVFVCICLIWFYRIGEIGDNR--
OsCslE1      (7) ATAAERRRPLFTTEELGGRAVYRVQAATVAAGILLVYYYRATRVPA----
OsCslE5      (1) --------------------------------------------------
AtCslG1      (5) RKNSVVGNILHTCHPCRRTIPYRIYAIFHTCGIIALMYHHVHSLVT----
AtCslG2      (5) RK---HSTALHTCHPCRRTIPYRIYAVFHTCGIIALMYHHVHSIVN----
AtCslG3      (5) RKHSVGDTTLHTCHPCRRTIPYRIYAVFHTCGIIALMYHHVHSLLT----
AtCslC12   (154) ----SKLQLQFIFNKGFFDWVYTRWVLLRVEYLAPPLQFLANGCIV----
OsCslC1    (142) -----AVVPDLLAVEGLFAAAYASWLRVRLEYLAPGIQFLANACVV----
OsCslC7     (29) -----EEVASLLAVDGLFAASYAGWMRLRLDYLAPPLQFLTNASVA----
OsCslC9     (53) -----LAASALALPVIGVESLYASWLRFATYVAPFLQFLTDACVV----
AtCslC5    (140) ----LHIPTSTLELQSLFHLVVVGWLTLRADYIAPPTKALSKFCIV----
AtCslC8    (140) ----LHIPTSKLELQSLLHLFVVGWLSLRADYIAPPTKALSKFCIV----
OsCslC3    (168) LPEHLRMPE-KEELEGWLHRAVVAWLAFRIDYIAWALQKLSGFCIA----
OsCslC2    (151) ----LHVPE-AVELEGWAHSAYISWMSFRADYIRRPLEFLSKACLL----
AtCslC4    (120) --------RPSWEVYGLVEWSYMAWLSFRSDYIAPLVISLSRFCTV----
AtCslC6    (136) --------PPSVASAEVAVEVVYAWWLEIRASYLAPPLQSLTNVCIV----
OsCslA8     (1) --------------MMSGGLAWAWRAVRCGVVLPTLQLAVYVCVA----
OsCslA2     (1) ------------MASSSSSSLPAAWAAAVRAWAVAPALRAAVWACIA----
OsCslA4     (8) -----WRLAAAAAASSSGDQIAAAWAVVRARAVAPVLQFAVWACMA----
OsCslA5    (42) --------SSTSPGSGGGAWWREAWVGAFSRAVAPALQVGVWACMV----
OsCslA7    (61) -----GDEAAAGGVSVGVAAWYEVWVRVGGVIAPTLQVAVWVCMV----
OsCslA3    (23) -----ESLLLLLRWPSSAELVAAWGAARASAVAPALAAASAACLA----
OsCslA11   (18) -----GELPVRVVWAAVAAQWAAAAAAARAVVPALRALVAVSLA----
OsCslA6    (12) -----DRLLVADTVAAVVESLVQAWRQVRMELLVPLLRGAVVACMV----
AtCslA1     (1) --------------------------------------------------
AtCslA10   (35) ------LKKLETSINGARISFDTTWTREFISLFIVPLFKCLVAFCLI----
AtCslA15   (26) -------ETLKASVDGVGINMSTMWR-ETRNVFIVPLFKCIVVMCLI----
AtCslA11    (1) --------------------------------------------------
AtCslA14    (3) ------TLSDGLFDDMSVLGVIGYVLEQTRFIFLVPIKRLVNLCQV----
AtCslA3    (32) ------LDTTDGVVRSGIIGEIIYIWKQTRFVFIPILKCLVTICLV----
AtCslA7    (32) ------VAFLNAFKSEDIIARIGLWWQLIRAVVVVPVFKFLVLLCIV----
AtCslA2    (10) ------LPETFDGVRMEITGQLGMIWELVKAPVIVPLLQLAVYICLL----
PoXylS     (10) ------LPESLPGYNPDITGQIGLIWELIKTPLIIPVLRLSVYICLA----
OsCslA1     (1) ----------MEVNGGGAAGLPEAWSQVRAPVIVPLLRLAVAVCLT----
OsCslA9     (1) ----------MAAAGAVLPEQIAAMWEQVKAPVVVPLLRLSVAACLA----
AtCslA9    (10) ------IPDSFMGYRDDITMQMSMVLDQIRAPLIVPALRLGVYICIT----
PtCslA1    (10) ------LPESFPSN--DMTEQLALIWRQIRAPLIAPLLRFAVGICLI----
PtCslA2    (12) ------LPQTFQGTRDDIVEQIALLWQQIRAPLVAPLLNICIYFCLL----
CtManS      (5) ------IFEEPEGIPGNSSSSLRYAWQSIRAPVIIPLLKLAVIVCSV----
PpCslA1     (2) ------AESGSTGGLPMLVDQLVKIWLEVRGPVVAPVLQFAINVCIV----
Consensus (351)        PL   V  I     YRI  IVLRL VL     L YRI   V
                 401                                              450
AtCesA1   (299) ---------NAYPLWITSVICEIWFAFSWLLDQFPKWYPINRETYLDRLA
AtCesA10  (286) ---------DAYALWITSVICEIWFAFSWLLDQFPKWYPINRETFLDRLA
```

Figure 5N

```
ZmCesA1   (295)  ---------DAYGLWLVSVICEVWFALSWLLDQFPKWYPINRETYLDRLA
ZmCesA2   (294)  ---------NAYGLWLVSVICEVWFALSWLLDQFPKWYPINRETYLDRLA
ZmCesA3   (289)  ---------DAYGLWLVSVICEVWFALSWLLDQFPKWYPINRETYLDRLA
AtCesA2   (301)  ---------DAYGLWLTSVICEIWFAVSWILDQFPKWYPIERETYLDRLS
AtCesA9   (306)  ---------DAFGLWLTSVICEIWFAVSWILDQFPKWYPIERETYLDRLS
AtCesA5   (288)  ---------DAYALWLISVICEIWFAVSWVLDQFPKWYPIERETYLDRLS
AtCesA6   (300)  ---------DAYALWLISVICEIWFAVSWVLDQFPKWYPIERETYLDRLS
ZmCesA6   (268)  ---------DAFALWLISVICEIWFAMSWILDQFPKWFPIERETYLDRLS
ZmCesA7   (297)  ---------DAFALWLISVICEIWFAMSWILDQFPKWFPIERETYLDRLS
ZmCesA8   (305)  ---------DAFALWLISVICEIWFAMSWILDQFPKWLPIERETYLDRLS
AtCesA3   (283)  ---------NAFALWLVSVICEIWFALSWILDQFPKWFPVNRETYLDRLA
ZmCesA4   (298)  ---------NAYPLWLLSVICEIWFALSWILDQFPKWFPINRETYLDRLA
ZmCesA9   (300)  ---------NAYPLWLLSVICEIWFALSWILDQFPKWFPINRETYLDRLA
ZmCesA5   (297)  ---------NAYPLWLLSVICEIWFALSWILDQFPKWSPINRETYLDRLA
AtCesA7   (262)  ---------DALGLWLTSVICEIWFAVSWILDQFPKWFPIERETYLDRLS
ZmCesA12  (289)  ---------DAIGLWLVSIICEIWFALSWILDQFPKWFPIDRETYLDRLS
ZmCesA13  (289)  ---------DAIGLWLVSIICEIWFAVSWILDQFPKWFPIDRETYLDRLT
AtCesA4   (206)  ---------DAYPLWLISVICEIWFALSWILDQFPKWFPINRETYLDRLS
ZmCesA10  (257)  ---------DAVPLWLASVICELWFAFSWILDQLPKWAPVTRETYLDRLA
AtCesA8   (208)  ---------SAYGLWLTSVICEIWFAVSWVLDQFPKWSPINRETYIDRLS
ZmCesA11  (207)  ---------SAFGLWMTSVICEIWFGFSWILDQFPKWYPINRETYVDRLI
AtCslD1   (206)  ---------EDAMWLWGLSIVCEIWFAFSWILDILPKLNPINRATDLAALH
AtCslD2   (320)  ---------PDAVWLWGMSVVCELWFALSWLLDQLPKLCPINRATDLQVLK
AtCslD3   (317)  ---------PDAIWLWGMSVVCELWFALSWLLDQLPKLCPINRATDLNVLK
OsCslD2   (339)  ---------EDAMWLWGMSVVCELWFGLSWLLDQLPKLCPVNRATDLAVLK
OsCslD1   (290)  ---------EDAIWLWGMSIVCELWFALSWVLDQLPKLCPINRATDLSVLK
AtCslD4   (295)  ---------EDAIWLWLMSIICELWFGFSWILDQIPKLCPINRSTDLEVLR
OsCslD3   (320)  ---------MEALWLWGMSIVCELWFAFSWLLDMLPKVNPVNRSTDIAVLK
AtCslD5   (341)  ---------REAMWLWGMSTTCELWFALSWLLDQLPKLCPVNRLTDLGVLK
AtCslD6   (145)  ---------NKALWLWLLSVICELWFAFSWLLDQIPKLFPVNHATDIEALK
OsCslF7    (88)  TDAGGIGMSKAATFWTASIAGELWFAFMWVLDQLPKTMPVRRAVDVTALN
OsCslF1    (91)  ---------RDGAWLWTMSMVGDVWFGFSWVLNQLPKYQSPIKRVPDAALA
OsCslF2   (121)  ---------RDGVWLWTMSMVGDVWFGFSWVLNQLPKLSPIKRVPDAALA
OsCslF4   (113)  ---------RDGAWLWTMSMAGDVWFGFSHALQQLPKLNPIKRVADLAALA
OsCslF3   (114)  ---------SDIMWFWTMSVAGDVWFGFSWLLNQLPKFNPVKTIPDLTALR
AtCslB1     (4)  ---------NNSVWWVAFLCESFFSFIWLLITSIKWSEASYKSYPERLD
AtCslB2    (47)  ---------KDTVWIVAFLCETCFTFVWLLITNIKWSEADYKTYPERLD
AtCslB4    (47)  ---------NGILWLVAFLCESCFSFVWLLSTCTKWSEAETKPYPERLD
AtCslB3    (47)  ---------YDNVWLVAFFCESCFFLVCLLITCLKWSEADTKPFPDRLD
AtCslB5    (47)  ---------NDNVWLLAFFCLSCFSLVWLIFTCLKWSEAEDIPYINTEN
AtCslB6    (47)  ---------NNTIWLVAFLCESCFSFMWLIITCIKWSEAEDKPYPNRLD
OsCslH1    (47)  ----------APWRRAALACEAWFTFMWLLNVNAKWSPVRFDTFPENLA
OsCslH2    (77)  ---------GGDAGVWRVALVCEAWFAALCALNVSAKWSPVRFVTRPENIV
AtCslE1    (59)  --------TVLDRLIWFVMFIVEIWFGLYWVVTQSSRWNPVWRFPFSDRLS
OsCslE1    (53)  --------AGEGRAAWIGMAAAELWFAVYWVIAQSVRWREFRRRTFRDRLA
OsCslE5     (1)  --------------------------------------------------
AtCslG1    (51)  --------AN-NTLITCLLLISDIVLAFMWATTTSLRLNPVHRTECPEKYA
AtCslG2    (48)  --------AN-NTLITCLLLISDIVLAFMWATTTSLRLNPIHRTEYPEKYA
AtCslG3    (51)  --------AN-TTLITSLLLISDIVLAFMWATTTSLRYKPVRRTEYPEKYA
AtCslC12  (196)  ---------LFLVQSLDRLILCLGCFWIRFKKIKPV---PKPDSIS
OsCslC1   (183)  ---------LFLIQSADRLILCLGCLWIKLKGIKPV---PKASGGG
OsCslC7    (70)  ---------LFMVQSLDRLVLCLGCFWIRFKGIKPV---PQAAAAG
OsCslC9    (94)  ---------LFLIQSADRLIQCLGCFYIHLKRIKPN---PKSPALP
AtCslC5   (182)  ---------LFLIQSVDRLVLCLGCFWIKYKKIKER---FDESPFR
```

Figure 5O

```
AtCslC8    (182)  --------------LFLVQSVDRLILCLGCLWIKFKKIKPR---IDEEHFR
OsCslC3    (213)  --------------LFMVQSVDRLVLCLGCFWIKLRGIKE----VADTSLS
OsCslC2    (192)  --------------LFVIQSMDRLVLCLGCFWIKLRKIKPR---IEGDPFR
AtCslC4    (158)  --------------LFLIQSLDRLVLCLGCFWIKFKKIEPK---LTEESLD
AtCslC6    (175)  --------------LFLIQSVDRLVLVLGCFWIKLRRIKPV---ASMEYPT
OsCslA8     (32)  --------------MSIMLFLERLYMALVVAALWLIRRRRRSNRREQDDD
OsCslA2     (36)  --------------MSAMLVAEAAWMGLASLAAAAARRLRGYG-YRWEPMA
OsCslA4     (49)  --------------MSVMLVLEVAYMSLVSLVAVKLLRRVPERRYKWEPIT
OsCslA5     (80)  --------------MSVMLVVEATYNSAVSVAARLVGWRPERW-FKWEPLG
OsCslA7    (102)  --------------MSVMLVVEATFNSAVSLGVKAIGWRPEWR-FKWEPLA
OsCslA3     (64)  --------------LSAMLLADAVLMAAACFAR----RRP-DRRYRATPLG
OsCslA11    (59)  --------------MTVMILAEKLFVAAVCLAVRAFRLRPDRR-YKWLPLG
OsCslA6     (53)  --------------MSVILAEKLGVVSAMVKLLRRRP-ARLYRCDPVV
AtCslA1      (1)  --------------------------------------------------
AtCslA10    (76)  --------------ISLLVFIEGIYMNLVVLYVKVFERKP----EKVYRWE
AtCslA15    (65)  --------------ISLLVFVESVYMNLVVLYVKLFNRKP----EKVYKWE
AtCslA11     (1)  --------------------------------------------------
AtCslA14    (44)  --------------VSVLLFVDAAYMALVVALVKLLGRTP----QKVLKWE
AtCslA3     (73)  --------------MSLLLFIERVYMSIVVVFVKLLRRTP----EKVHKWE
AtCslA7     (73)  --------------MSVMFFVEVMYMGIVVLYVKLFKRKP----EKFYKWE
AtCslA2     (51)  --------------MSVMLLCERVYMGIVIVIVKLFWKKPDKR-YKFEPTH
PoXylS      (51)  --------------MSIMVEMERLYMGVVIVLVRLFWKKPEQR-YKWEPME
OsCslA1     (37)  --------------MSVLLELERMYMAVVISGVKILRRRPDRR-YRCDPIP
OsCslA9     (38)  --------------MSVMLFVEKVYMSVVLVGVHLFGRRPDRR-YRCDPIV
AtCslA9     (51)  --------------MSVMLFVERVYMGIVISIVKLFGRKPDKR-FKYEPIK
PtCslA1     (49)  --------------MSLMLFIERVYMAVVIVLVKLFGKRPEKR-YKWEPLR
PtCslA2     (53)  --------------MSVMLFIERVYMAVVIVLIKLFGKKPEKR-YKWGALK
CtManS      (46)  --------------MSIMLFVERVAMAAVILIVKVLRKKR-------YTKY
PpCslA1     (43)  --------------MVTMLFVERLFMCGVMVFVKLLRRTE-------ETQF
Consensus  (401)               LWLMSVI EIWFAL WLL   K PI R    LD L
                  451                                              500
AtCesA1    (340)  LRYDR-----------DGEPSQLVPVDVFVSTVDPLKEPPLVTANTVLSI
AtCesA10   (327)  LRYDR-----------DGEPSQLAPVDVFVSTVDPMKEPPLVTANTVLSI
ZmCesA1    (336)  LRYDR-----------EGEPSQLAPIDVFVSTVDPLKEPPLITANTVLSI
ZmCesA2    (335)  LRYDR-----------EGEPSQLAPIDVFVSTVDPLKEPPLITANTVLSI
ZmCesA3    (330)  LRYDR-----------EGEPSQLAPIDVFVSTVDPLKEPPLITGNTVLSI
AtCesA2    (342)  LRYEK-----------EGKPSGLAPVDVFVSTVDPLKEPPLITANTVLSI
AtCesA9    (347)  LRYEK-----------EGKPSELAPVDVFVSTVDPLKEPPLITANTVLSI
AtCesA5    (329)  LRYEK-----------EGKPSELAGVDVFVSTVDPMKEPPLITANTVLSI
AtCesA6    (341)  LRYEK-----------EGKPSGLSPVDVFVSTVDPLKEPPLITANTVLSI
ZmCesA6    (309)  LRFDK-----------EGHPSQLAPVDFFVSTVDPLKEPPLVTANTVLSI
ZmCesA7    (338)  LRFDK-----------EGQPSQLAPIDFFVSTVDPLKEPPLVTTNTVLSI
ZmCesA8    (346)  LRFDK-----------EGQPSQLAPIDFFVSTVDPTKEPPLVTANTVLSI
AtCesA3    (324)  LRYDR-----------EGEPSQLAAVDIFVSTVDPLKEPPLVTANTVLSI
ZmCesA4    (339)  LRYDR-----------EGEPSQLAAVDIFVSTVDPMKEPPLVTANTVLSI
ZmCesA9    (341)  LRYDR-----------EGEPSQLAAVDIFVSTVDPMKEPPLVTANTVLSI
ZmCesA5    (338)  LRYDR-----------EGEPSQLAPVDIFVSTVDPMKEPPLVTANTVLSI
AtCesA7    (303)  LRYER-----------EGEPNMLAPVDVFVSTVDPLKEPPLVTSNTVLSI
ZmCesA12   (330)  LRYER-----------EGEPSLLSAVDLFVSTVDPLKEPPLVTANTVLSI
ZmCesA13   (330)  LRYER-----------EGEPSLLSSVDLFVSTVDPLKEPPLVTANTVLSI
AtCesA4    (247)  MRFER-----------DGEKNKLAPVDVFVSTVDPLKEPPIITANTILSI
ZmCesA10   (298)  LRYDR-----------EGEACRLSPIDFFVSTVDPLKEPPIITANTVLSI
AtCesA8    (249)  ARFER-----------EGEQSQLAAVDFFVSTVDPLKEPPLITANTVLSI
ZmCesA11   (248)  ARYG------------LGEESGLAPVDFFVSTVDPLKEPPLITANTVLSI
```

Figure 5P

```
AtCslD1   (248) DKFEQPSP------SNPTGRSDLPGVDVFVSTADPEKEPPLVTANTLLSI
AtCslD2   (362) EKFETPTA------SNPTGKSDLPGFDVFVSTADPEKEPPLVTANTILSI
AtCslD3   (359) EKFETPTP------SNPTGKSDLPGLDMFVSTADPEKEPPLVTSNTILSI
OsCslD2   (381) DKFETPTP------SNPNGRSDLPGLDIFVSTADPEKEPPLVTANTILSI
OsCslD1   (332) DKFETPTP------SNPTGKSDLPGIDIFVSTADPEKEPVLVTANTILSI
AtCslD4   (337) DKFDMPSP------SNPTGRSDLPGIDLFVSTADPEKEPPLVTANTILSI
OsCslD3   (362) EKFETPSP------SNPHGRSDLPGLDVFVSTADPEKEPVLTTATTILSI
AtCslD5   (383) ERFESPNL------RNPKGRSDLPGIDVFVSTADPEKEPPLVTANTILSI
AtCslD6   (187) ATFETPNP------DNPTGKSDLPGIDVFVSTADAEKEPPLVTANTILSI
OsCslF7   (138) DDT----------------LLPAMDVFVTTADPDKEPPLATANTVLSI
OsCslF1   (133) DRHS---------------GDLPGVDVFVTIVDPVDEFILYTVNTILSI
OsCslF2   (163) DRHS---------------GDLPGVDVFVTIVDPVDEFILYTVNTILSI
OsCslF4   (155) DRQQHGT--------S--GGGELPGVDVFVTIVDPVDEFILYTVNSILSI
OsCslF3   (156) QYCDLAD--------G---SYRLPGIDVFVTIADPTDEFVLYTMCVLSI
AtCslB1   (44)  ER-----------------VHDLPSVDMFVTTADPVREPPIIVANTLLSL
AtCslB2   (87)  ER-----------------VHELPPVDMFVTTADPVREPPLIVVNTVLSL
AtCslB4   (87)  ER-----------------VYDLPSVDMFVPTADPVREPPIMVVNTVLSL
AtCslB3   (87)  ER-----------------VHDLPSVDMFVPTADPVREPPIMVVDTVLSL
AtCslB5   (87)  ER-----------------VHDLPSLDMFVPTALTVRESPTITVNTVLSL
AtCslB6   (87)  ER-----------------VHDLPSVDMFVPTADPVREPPIIVVNTVLSL
OsCslH1   (86)  ER-----------------IDELPAVDMFVTTADPVLEPPLVTVNTVLSL
OsCslH2   (119) AEGRTPS-------TTAAEYGELPAVDMLVTTADPALEPPLVTVNTVLSL
AtCslE1   (102) RR--Y--------------GSDLPRLDVFVCTADPVIEPPLLVVNTVLSV
OsCslE1   (96)  ERSRY--------------EQNLPGVDIFVCTADPQSEPPSLVISTILSV
OsCslE5   (1)   -MSFG--------------ACMKKKLDIFVCTADPHSEPPSLVISTVVSV
AtCslG1   (93)  AKP----------------EDFPKLDVFICTADPYKEPPMMVVNTALSV
AtCslG2   (90)  AKP----------------EDFPKLDVFICTADPYKEPPMMVVNTALSV
AtCslG3   (93)  AEP----------------EDFPKLDVFICTADPYKEPPMMVVNTALSV
AtCslC12  (230) -------------DLESGDNGA-----FLPMLVQIPMCNEKEVYQQSIAAV
OsCslC1   (217) GGGKG--------SDDVEAGAD-----EFPMLVQIPMCNEKEVYQQSIGAV
OsCslC7   (104) -------------KPDVEAGAG-----DYPMLVQMPMCNEREVYQQSIGAV
OsCslC9   (128) -------------DAEDPDAA------YYPMLVQIPMCNEKEVYQQSIAAV
AtCslC5   (216) NDDA---------EGSGSE--------YPMLVQIPMCNEREVYEQSISAV
AtCslC8   (216) NDDF---------EGSGSE--------YPMLVQIPMCNEREVYEQSISAV
OsCslC3   (246) NDDI---------EATAGDGGG-----YFPMLIQMPMCNEKEVYETSISHV
OsCslC2   (226) -------------EGSGYQ--------HPMLVQIPMCNEKEVYEQSISAA
AtCslC4   (192) --------------LED--PS------SFPMLIQIPMCNEREVYEQSISAA
AtCslC6   (209) KLVG---------EGVRLE--------DYPMVIVQIPMCNEKEVYQQSIGAV
OsCslA8   (69)  G------------AENDQLLQDPEAANSPMLVQIPMFNEKQVYRLSIGAA
OsCslA2   (72)  APP----------DVFAPAP-APAEFPMLVQIPMYNEKEVYKLSIGAA
OsCslA4   (86)  TGSGGVGGGDGEDEEAATGGR-EAAAFPMLVQIPMYNEKEVYKLSIGAA
OsCslA5   (116) GGAGA--------GDEEKGEA-AAAAYPMVMVQIPMYNELEVYKLSIGAV
OsCslA7   (138) G------------ADEEKG----RGEYPMVMVQIPMYNELEVYKLSIGAA
OsCslA3   (96)  AGAG---------ADDDDDEEA-GRVAYPMLVQIPMYNEREVYKLSIGAA
OsCslA11  (95)  AAAAAAS------SEDDEESGLVAAAAFPMLVQIPMFNEREVYKLSIGAA
OsCslA6   (89)  V------------EDDDEAGR-----ASFPMLVQIPMYNEKEVYQLSIGAA
AtCslA1   (1)   --------------------------------------------------
AtCslA10  (109) ---AM--------QEDIELGH----ETYPMLVQIPMYNEKEVLQLSIGAA
AtCslA15  (98)  ---AM--------QEDMELGH----QNYPMLVQIPMYNEREVFELSIGAA
AtCslA11  (1)   ----M--------QEDLFLGN----QNFPMLVQIPMYNEREVFKLSIGAA
AtCslA14  (77)  S--FK--------SDDIELAPS---SNHPMLIQIPIFNEKEVCQLSIGAA
AtCslA3   (106) P--IN--------DDDLELAN----TNYPMLIQIPMYNEKEVCQLSIGAA
AtCslA7   (106) ---AM--------EDDVECGS----ASYPMLVQIPMYNEKEVCEQSIAAA
AtCslA2   (87)  -------------DDEELGSS----NFPVLVQIPMFNEREVYKLSIGAA
```

Figure 5Q

```
PoXylS      (87)  --------------DDIEDANA-----AYPIVLVQIPMFNEREVYKISIGAA
OsCslA1     (73)  --------------DDDPELGTS-----AFPVVLIQIPMFNEREVYQLSIGAV
OsCslA9     (74)  AAGAD---------NDDPELADA---NAAFPMVLIQIPMYNEREVYKLSIGAA
AtCslA9     (87)  --------------DDIELGNS-----AYPMVLIQIPMFNEREVYQLSIGAA
PtCslA1     (85)  --------------DDIELGNS-----AYPMVLVQIPMYNEKEVYQLSIGAA
PtCslA2     (89)  --------------EDVELGNS-----VYPMVLVQIPMYNEREVYQLSIGAA
CtManS      (76)  NLEAM---------KQKLER-SK----KYPMVLIQIPMYNEKEVYKLSIGAV
PpCslA1     (73)  KFEAI---------QDDLEFGNS----SYPMVLVQIPMFNEREVYQLSIQAA
Consensus   (451)   R            E    S L     VDVFV T DPM EPPLV  NTILSI
                  501                      *                            550
AtCesA1    (379)  LSVDYPVD--KVACYVSDDGSAMLTFESLSETAEFAKKWVPFCKKFNIEP
AtCesA10   (366)  LAVDYPVD--KVACYVSDDGSAMLTFEALSETAEFSKKWVPFCKKFNIEP
ZmCesA1    (375)  LSVDYPVD--KVSCYVGDDGSAMLTFESLSETAEFARKWVPFCKKHNIEP
ZmCesA2    (374)  LAVDYPVD--KVSCYVSDDGSAMLTFESLSETAEFARKWVPFCKKHNIEP
ZmCesA3    (369)  LAVDYPVD--KVSCYVSDDGSAMLTFEALSETAEFARKWVPFCKKHNIEP
AtCesA2    (381)  LAVDYPVD--KVACYVSDDGAAMLTFEALSDTAEFARKWVPFCKKFNIEP
AtCesA9    (386)  LAVDYPVE--KVACYVSDDGAAMLTFEALSYTAEFARKWVPFCKKFSIEP
AtCesA5    (368)  LAVDYPVD--RVACYVSDDGAAMLTFEALSFTAEFARKWVPFCKKYTIEP
AtCesA6    (380)  LAVDYPVD--KVACYVSDDGAAMLTFEALSETAEFARKWVPFCKKYCIEP
ZmCesA6    (348)  LSVDYPVD--KVSCYVSDDGAAMLTFEALSPTSEFAKKWVPFCKRYSLEP
ZmCesA7    (377)  LSVDYPVD--KVSCYVSDDGAAMLTFEALSPTSEFAKKWVPFCKRYNIEP
ZmCesA8    (385)  LSVDYPVE--KVSCYVSDDGAAMLTFEALSETSEFAKKWVPFSKKFNIEP
AtCesA3    (363)  LAVDYPVD--KVSCYFDDGAAMLSFESLAETSEFARKWVPFCKKYSIEP
ZmCesA4    (378)  LAVDYPVD--KVSCYVSDDGAAMLTFDALAFTSEFARKWVPFVKKYNIEP
ZmCesA9    (380)  LAVDYPVD--KVSCYVSDDGAAMLTFDALAFTSEFARKWVPFVKKYNIEP
ZmCesA5    (377)  LAVDYPVD--KVSCYVSDDGAAMLTFDALSETSEFARKWVPFCKKYNIEP
AtCesA7    (342)  LAMDYPVE--KISCYVSDDGASMLTFESLSETAEFARKWVPFCKKFSIEP
ZmCesA12   (369)  LAVDYPVD--KVSCYVSDDGASMLTFESLSETAEFARKWVPFCKKFGIEP
ZmCesA13   (369)  LAVDYPVD--KVSCYVSDDGASMLTFEALSETAEFARKWVPFCKKFCIEP
AtCesA4    (286)  LAVDYPVN--KVSCYVSDDGASMLLFDTLSETSEFARRWVPFCKKYNVEP
ZmCesA10   (337)  LAVDYPVD--RVSCYVSDDGASMLLFDALSETAEFARRWVPFCKKFAVEP
AtCesA8    (288)  LALDYPVD--KVSCYVSDDGAAMLSFESLVETADFARKWVPFCKKYSIEP
ZmCesA11   (286)  LAVDYPVE--KISCYVSDDGSAMLTFESLAETAEYARKWVPFCKKYAIEP
AtCslD1    (292)  LAVDYPIE--KLSAYISDDGGAILTFEAMAIAVRFAEYWVPFCRKHDIEP
AtCslD2    (406)  LAAEYPVE--KLSCYVSDDGGALLTFEAMAEAASFANIWVPFCRKHAIEP
AtCslD3    (403)  LAADYPVE--KLACYVSDDGGALLTFEAMAEAASFANMWVPFCRKHNIEP
OsCslD2    (425)  LAADYPVE--KLSCYVSDDGGALLTFEAMAEAASFANMWVPFCRKHNIEP
OsCslD1    (376)  LAADYPVD--KLACYVSDDGGALLTFEAMAEAASFANLWVPFCRKHEIEP
AtCslD4    (381)  LAVDYPVE--KVSCYLSDDGGALLSFEAMAEAASFADLWVPFCRKHNIEP
OsCslD3    (406)  LAVDYPVE--KLACYVSDDGGALLTFEAMAEAASFANVWVPFCRKHDIEP
AtCslD5    (427)  LAVDYPVE--KLACYLSDDGGALLTFEALAQTASFASTWVPFCRKHNIEP
AtCslD6    (231)  LSVDYPVE--KLSVYISDDGGSLVTFEAIAEAASFAKIWVPFCRKHKIEP
OsCslF7    (170)  LAAGYPAG--KVTCYVSDDAGAEVIRGAVVEAARFAALWVPFCRKHGVEP
OsCslF1    (167)  LAADYPVD--RYACYLSDDGGTLVHYEAMVEVAKFAELWVPFCRKHCVEP
OsCslF2    (197)  LAADYPVD--RYACYLSDDGGTLVHYEAMVEVAKFAELWVPFCRKHCVEP
OsCslF4    (195)  LAADYPVD--RYACYLSDDGGTLVHYEAMVEVAKFAELWVPFCRKHCVEP
OsCslF3    (195)  LAADYPVD--RSACYLSDDSGALILYEALVETAKFATLWVPFCRKHCIEP
AtCslB1    (77)   LAVNYPAN--KLACYVSDDGCSPLTYFSLKEASKFAKIWVPFCKKYNIKV
AtCslB2    (120)  LAVNYPAN--KLACYVSDDGCSPLTYFSLKEASKFAKIWVPFCKKYNVRV
AtCslB4    (120)  LAVNYPAN--KLACYVSDDGCSPLTYFSLKEASKFAKIWVPFCKKYNLKV
AtCslB3    (120)  LAVNYPAN--KLACYVSDDGCSPLTYFSLKEASKFAKIWVPFCKKYNTRV
AtCslB5    (120)  LAVNYPAN--KLACYVSDDGCSPLTYFSLKEASKFVKIWAPFCKKYNVRV
AtCslB6    (120)  LAVNYPAN--KLACYVSDDGCSPLTYFSLKEASKFVKIWAPFCKKYNVRV
OsCslH1    (119)  LALDYPAAGEKLACYVSDDGCSPLTCYAIREAARFARTWVPFCRRHGVAV
```

Figure 5R

```
OsCslH2    (162) LALDYPRAGERLACYVSDDGCSPLTCHALREAAGFAAANVPFCRRYGVAV
AtCslE1    (136) TALDYPPE---KLAVYLSDDGGSELTFYALTEAAEFAKTWVPFCKKFNVEP
OsCslE1    (132) MAYNYPSE---KISVYLSDDGGSILTFYALWEASIFAKKWLPFCKRYNIEP
OsCslE5     (36) MAYNYPSK---KLRVYLSDDGGSILTFYALWEASVFAKHWLPFCKKYNIEP
AtCslG1    (126) MAYEYPSD---KISVYVSDDGGSSLTFFALIEAAKFSKQWLPFCKKNNVQD
AtCslG2    (123) MAYEYPSH---KISVYVSDDGGSSLTLFALMEAAKFSKHWLPFCKNNNVQD
AtCslG3    (126) MAYEYPSD---KISVYVSDDGGSSLTLFALMEAAKFSKHWLPFCKNNNVQD
AtCslC12   (264) CNLDWPKG---KILIQVLDDSDDPITQS----------------------
OsCslC1    (256) CNLDWPRS---NFLVQVLDDSDDAAISA----------------------
OsCslC7    (138) CNLDWPKS---NFLVQVLDDSDDATISA----------------------
OsCslC9    (161) CNLDWPRS---NFLVQVLDDSDDPTIQT----------------------
AtCslC5    (250) CQLDWPKD---RILVQVLDDSNDESIQQ----------------------
AtCslC8    (250) CQLDWPKD---RLLVQVLDDSDDESIQE----------------------
OsCslC3    (284) CQIDWPRE---RMLVQVLDDSDDETCQM----------------------
OsCslC2    (256) CQLDWPRE---KFLIQVLDDSSDESIQL----------------------
AtCslC4    (222) SQLDWPKD---RILIQVLDDSDDPNLQL----------------------
AtCslC6    (244) CMLDWPRE---RMLVQVLDDSSELDVQQ----------------------
OsCslA8    (108) CGMTWPSD---KLVIQVLDDSTDPAIRE----------------------
OsCslA2    (110) CALTWPPD---RIIIQVLDDSTDPFVKFSLVQE------------------
OsCslA4    (135) CALTWPPD---RIIIQVLDDSTDPAIKD----------------------
OsCslA5    (157) CGLKWPKE---RLIIQVLDDSTDAFIKN----------------------
OsCslA7    (172) CELKWPKD---KLIVQVLDDSTDPFIKN----------------------
OsCslA3    (138) CGLSWPSD---RLIVQVLDDSTDPTVKTWYDRLRKTLVQQAHPAQADMDVH
OsCslA11   (141) CSLDWPSD---RVVIQVLDDSTDLVVKVFLVIYFTDISSR-----------
OsCslA6    (124) CRLTWPAD---RLIVQVLDDSTDAIVKE----------------------
AtCslA1      (1) ------MV---DLVVQVVDDFTDPAVRE----------------------
AtCslA10   (145) CRLIWPLD---RLIVQVLDDSTDQTIKE----------------------
AtCslA15   (134) CRLTWPSD---RLIVQVLDDSTDPAIME----------------------
AtCslA11    (36) CRLIWPLD---RLIVQVLDDSTDPTIME----------------------
AtCslA14   (115) CKLSWPLD---RMIIQVLDDSTEEESQK----------------------
AtCslA3    (143) CRLSWPLD---RMIVQVLDDSTDPASKE----------------------
AtCslA7    (142) CKISWPSN---RIIIQVLDDSTDPASKE----------------------
AtCslA2    (120) CGLSWPSD---RLVIQVLDDSTDPTVKQ----------------------
PoXylS     (120) CNLSWPAD---RLVIQVLDDSTDFTIKD----------------------
OsCslA1    (107) CGLSWPSD---RLVVQVLDDSTDPVIKE----------------------
OsCslA9    (115) CGLSWPSD---RVIVQVLDDSTDPVIKE----------------------
AtCslA9    (120) CGLSWPSD---RIVIQVLDDSTDPTIKD----------------------
PtCslA1    (118) CGLSWPSD---RIIQVLDDSTDPAIKE----------------------
PtCslA2    (122) CALSWPSN---RVIIQVLDDSTDLTIKD----------------------
CtManS     (114) CGLSWPAD---RFIVQVLDDSTNPVLRE----------------------
PpCslA1    (112) CGLSWPQD---RMIIQVLDDSTDQTIRE----------------------
Consensus  (501) LALDYP D   KLSCYVSDDG A LTFEAL E A  FA  WVPFCKK   I
                 551                                             600
AtCesA1    (427) RAPEFYPA--------------QKIDYLKDKIQPSFVKERRAM-------
AtCesA10   (414) RAPEFYPS--------------QKIDYLKDKIQPSFVKERRAM-------
ZmCesA1    (423) RAPEFYPA--------------QKIDYLKDKIQPSFVKERRAM-------
ZmCesA2    (422) RAPEFYPA--------------QKIDYLKDKIQPSFVKERRAM-------
ZmCesA3    (417) RAPEFYPA--------------RKIDYLKDKIQPSFVKERRAM-------
AtCesA2    (429) RAPEWYFS--------------QKMDYLKNKVHPAFVRERRAM-------
AtCesA9    (434) RAPEWYFS--------------QKMDYLKHKVDPAFVMERRAM-------
AtCesA5    (416) RAPEWYFC--------------HKMDYLKNKVHPAFVRERRAM-------
AtCesA6    (428) RAPEWYFC--------------HKMDYLKNKVHPAFVRERRAM-------
ZmCesA6    (396) RAPEWYFQ--------------QKIDYLKDKVAPNFVRERRAM-------
ZmCesA7    (425) RAPEWYFQ--------------QKIDYLKDKVAANFVRERRAM-------
```

Figure 5S

```
ZmCesA8   (433) RAPEWYEQ--------------QKIDYLKDKVAASFVRERRAM--------
AtCesA3   (411) RAPEWLEA--------------AKIDYLKDKVQTSFVKDRRAM--------
ZmCesA4   (426) RAPEWYES--------------QKIDYLKDKVHPSFVKDRRAM--------
ZmCesA9   (428) RAPEWYES--------------QKIDYLKDKVHPSFVKDRRAM--------
ZmCesA5   (425) XAPEWYEA--------------QKIDYLKDKVQTSFVKERRAM--------
AtCesA7   (390) RAPEMYET--------------LKVDYLQDKVHPTFVKERRAM--------
ZmCesA12  (417) RAPEFYES--------------LKVDYLKDKVQPTFVQERRAM--------
ZmCesA13  (417) RAPEFYES--------------LKVDYLKDKVQPTFVQERRAM--------
AtCesA4   (334) RAPEFYES--------------EKIDYLKDKVQTTFVKDRRAM--------
ZmCesA10  (385) RAPEFYES--------------QKIDYLKDKVQPTFVKERRAM--------
AtCesA8   (336) RAPEFYES--------------LKIDYLRDKVQPSFVKERRAM--------
ZmCesA11  (334) RAPEFYES--------------QKIDYLKDKIHPSFVKDRRAM--------
AtCslD1   (340) RNPDSYES--------------IKKDPTKNKKRQDFVKDRRWI--------
AtCslD2   (454) RNPDSYES--------------LKRDPYKNKVKSDFVKDRRRV--------
AtCslD3   (451) RNPDSYES--------------LKRDPYKNKVKADFVKDRRRV--------
OsCslD2   (473) RNPESYEN--------------LKRDPYKNKVRSDFVKDRRRV--------
OsCslD1   (424) RNPDSYEN--------------LKRDPFKNKVKGDFVKDRRRV--------
AtCslD4   (429) RNPDSYES--------------LKIDPTKNKSRIDFVKDRRKI--------
OsCslD3   (454) RNPDSYES--------------VKGDPTKGKRRNDFVKDRRRV--------
AtCslD5   (475) RNPEAYEG--------------QKRNFLKNKVRLDFVRERRRV--------
AtCslD6   (279) RNPESYEG--------------LKRDPYKDKVRHDFVRERRYV--------
OsCslF7   (218) RNPEAYENGGEGGGGGGKARVVARGSYKGRAWPELVRDRRRV--------
OsCslF1   (215) RSPENYEA--------------MKTQAYKGGVPGELMSDHRRV--------
OsCslF2   (245) RSPENYEA--------------MKTQAYKGGVPGELMSDHRRV--------
OsCslF4   (243) RAPESYEA--------------MKTQAYRGGVAGELMSDRRRV--------
OsCslF3   (243) RSPESYEE--------------LEAPSYTGSAPEEFKNDSRIV--------
AtCslB1   (125) RAPFRYELN-------------PP-AATESSEFSKDWEIT--------
AtCslB2   (168) RAPFMYERN-------------SP-EAAEGSEFSKDWEMT--------
AtCslB4   (168) RAPFRYELN-------------PF-AATEGSEFSRDWEMT--------
AtCslB3   (168) RAPSRYELK-------------PISVATEDYEFNRDWEKT--------
AtCslB5   (168) RAPFRYELN-------------PL-VATDDSVFSKDWKMM--------
AtCslB6   (168) RAPFRYELN-------------PL-VATDDSVFSKDWKMMKIYKVFYY
OsCslH1   (169) RAPFRYESS-------------TPEFG-PADGKFLEDWTFM--------
OsCslH2   (212) RAPFRYESSS-------------SSPESGGPADRKFLDDWTFM--------
AtCslE1   (184) TSPAAYLSSKAN----------CLDSAAEEVAKL---------
OsCslE1   (180) RSPAAYESESK-----------VHHNLCIPK---------
OsCslE5   (84)  RPPAABIVESE-----------GHHNLCTPK---------
AtCslG1   (174) RSPEVYESSESH----------SRSDEAENLKTNILKCEVEQ--------
AtCslG2   (171) RSPEVYESSKSH----------SSSDEAENLK--IFNCVVEQ--------
AtCslG3   (174) RSPEVYESSKLR----------SRSDEAENIK---------
AtCslC12  (289) --------------------------------------------
OsCslC1   (281) --------------------------------------------
OsCslC7   (163) --------------------------------------------
OsCslC9   (186) --------------------------------------------
AtCslC5   (275) --------------------------------------------
AtCslC8   (275) --------------------------------------------
OsCslC3   (309) --------------------------------------------
OsCslC2   (281) --------------------------------------------
AtCslC4   (247) --------------------------------------------
AtCslC6   (269) --------------------------------------------
OsCslA8   (133) --------------------------------------------
OsCslA2   (140) --------------------------------------------
OsCslA4   (160) --------------------------------------------
OsCslA5   (182) --------------------------------------------
```

Figure 5T

```
OsCs1A7   (197)  --------------------------------------------------
OsCs1A3   (186)  QSTKRKNKELMTRVPILECDSNHGLASI------------------ISSYL
OsCs1A11  (178)  ----------------IIR---------------------------STSSL
OsCs1A6   (149)  --------------------------------------------------
AtCs1A1    (20)  --------------------------------------------------
AtCs1A10  (170)  --------------------------------------------------
AtCs1A15  (159)  --------------------------------------------------
AtCs1A11   (61)  --------------------------------------------------
AtCs1A14  (140)  --------------------------------------------------
AtCs1A3   (168)  --------------------------------------------------
AtCs1A7   (167)  --------------------------------------------------
AtCs1A2   (145)  --------------------------------------------------
PoXy1S    (145)  --------------------------------------------------
OsCs1A1   (132)  --------------------------------------------------
OsCs1A9   (140)  --------------------------------------------------
AtCs1A9   (145)  --------------------------------------------------
PtCs1A1   (143)  --------------------------------------------------
PtCs1A2   (147)  --------------------------------------------------
CtManS    (139)  --------------------------------------------------
PpCs1A1   (137)  --------------------------------------------------
Consensus (551)  R P   YF                            D
                 601                                              650
AtCesA1   (456)  --------KREYEEFKVRINALVAKAQKIPE-------------------
AtCesA10  (443)  --------KREYEEFKVRINILVAKAQKIPE-------------------
ZmCesA1   (452)  --------KREYEEFKVRINALVAKAQKVPE-------------------
ZmCesA2   (451)  --------KREYEEFKIRINALVAKAQKVPE-------------------
ZmCesA3   (446)  --------KRECEEFKVRIDALVAKAQKIPE-------------------
AtCesA2   (458)  --------KRDYEEFKVKINALVATAQKVPE-------------------
AtCesA9   (463)  --------KRDYEEFKVKINALVSVSQKVPE-------------------
AtCesA5   (445)  --------KRDYEEFKVKINALVATAQKVPE-------------------
AtCesA6   (457)  --------KRDYEEFKVKINALVATAQKVPE-------------------
ZmCesA6   (425)  --------KREYEEFKVRINALVAKAQKVPE-------------------
ZmCesA7   (454)  --------KREYEEFKVRINALVAKAQKVPE-------------------
ZmCesA8   (462)  --------KREYEEFKVRINALVAKAQKVPE-------------------
AtCesA3   (440)  --------KREYEEFKIRINALVSKALKCPE-------------------
ZmCesA4   (455)  --------KREYEEFKVRVNGLVAKAQKVPE-------------------
ZmCesA9   (457)  --------KREYEEFKLRVNGLVAKAQKVPE-------------------
ZmCesA5   (454)  --------KREYEEFKVRINGLVAKAQKVPE-------------------
AtCesA7   (419)  --------KREYEEFKVRINAQVAKASKVPL-------------------
ZmCesA12  (446)  --------KREYEEFKVRINALVAKAMKVPA-------------------
ZmCesA13  (446)  --------KREYEEFKVRINALVAKAMKVPA-------------------
AtCesA4   (363)  --------KREYEEFKVRINALVAKAQKKPE-------------------
ZmCesA10  (414)  --------KREYEEFKVRINALVAKAQKKPE-------------------
AtCesA8   (365)  --------KRDYEEFKIRMNALVAKAQKTPE-------------------
ZmCesA11  (363)  --------KRDYEEYKVRINALVAKAQKTPD-------------------
AtCs1D1   (369)  --------KREYDEFKVRINGLPEQIKKRAEQFNMREELKEKRIAREK---
AtCs1D2   (483)  --------KREFDEFKVRVNSLPDSIRRRSDAYHAREEIKAMKMQRQ----
AtCs1D3   (480)  --------KREYDEFKVRINSLPDSIRRRSDAYHAREEIKAMKLQRQ----
OsCs1D2   (502)  --------KREYDEFKVRINSLPDSIRRRSDAYHAREEIKAMKRQRE----
OsCs1D1   (453)  --------KREYDEFKVRVNGLPDAIRRRSDAYHAREEIQAMNLQREKMKA
AtCs1D4   (458)  --------KREYDEFKVRINGLPDSIRRRSDAFNAREEMKALKQMRE----
OsCs1D3   (483)  --------KREFDEFKVRINGLPDSIRRRSDAFNAREDMKMLKHLRE----
AtCs1D5   (504)  --------KREYDEFKVRINSLPEAIRRRSDAYNVHEELRAKKKQMEMMMG
AtCs1D6   (308)  --------KRAYDEFKVRVNALPHSIRRRSDAFNSKEEIKALEKWKHWKVK
```

Figure 5U

```
OsCslF7    (260)  --------RREYEEMRLRIDALQAADARR----------------RR----
OsCslF1    (244)  --------RREYEEFKVRIDSLSSTIRQRSDVYN-----------------
OsCslF2    (274)  --------RREYEEFKVRIDSLSSTIRQRSDVYN-----------------
OsCslF4    (272)  --------RREYEEFKVRIDSLFSTIRKRSDAYNR--AKD-----------
OsCslF3    (272)  --------HLEYDEFKVRLEALPETIRKRSDVYN---SMK-----------
AtCslB1    (151)  --------KREYEKLSRRVEDATGDSHWLDAED------------------
AtCslB2    (194)  --------KREYEKLSQKVEDATGSSHWLDAED------------------
AtCslB4    (194)  --------KREYEKLCRKVEDATGDSHLLGTDN------------------
AtCslB3    (195)  --------KREYEKLRRKVEDATGDSHMLDVED------------------
AtCslB5    (194)  --------KREYVKLCRKVEDATGDSHWLDADD------------------
AtCslB6    (202)  VYFCINMKREYVKLCRKVEDATGDSHWLDADD------------------
OsCslH1    (196)  --------KSEYEKLVHRIEDADEPSLLRHGGG------------------
OsCslH2    (242)  --------KDEYDKLVRRIKNTDERSLLRHGGGE-----------------
AtCslE1    (208)  ----------YREMAARIETAARLGRIPEEARVKYG---------------
OsCslE1    (200)  ----------EWALIKRIDTATMSGKIPEEMKLKH----------------
OsCslE5    (104)  ----------EWSFIKRIDTAVMLGKIPEEIKLNH----------------
AtCslG1    (206)  ---------MMYEDMKSRVEHVVESGKVETAFITCDQ--------------
AtCslG2    (201)  ---------MMYEDMKSRVEHVVESGKVETAFIACDQ--------------
AtCslG3    (196)  ---------MMYEDMKSRVEHVVESGKVETAFITCDQ--------------
AtCslC12   (289)  ---------------LIKEEVHKWQKLGA----------------------
OsCslC1    (281)  ---------------LIKEEVEKWQREGV----------------------
OsCslC7    (163)  ---------------LIKEEVEKWQREGV----------------------
OsCslC9    (186)  ---------------LIREEVLKWQQNGA----------------------
AtCslC5    (275)  ---------------LIKAEVAKWSQKGV----------------------
AtCslC8    (275)  ---------------LIRDEVTKWSQKGV----------------------
OsCslC3    (309)  ---------------LIKAEVTKWSQRGV----------------------
OsCslC2    (281)  ---------------LIKAEVSKWSHQGV----------------------
AtCslC4    (247)  ---------------LIKEEVSVWAEKGV----------------------
AtCslC6    (269)  ---------------LIKAEVQKWQQRGV----------------------
OsCslA8    (133)  ---------------MVEGECGRWAGKGV----------------------
OsCslA2    (140)  ---------------LVELECKEWASKKI----------------------
OsCslA4    (160)  ---------------LVELECKDWARKEI----------------------
OsCslA5    (182)  ---------------LVELECEDWASKGL----------------------
OsCslA7    (197)  ---------------LVELECESWASKGV----------------------
OsCslA3    (219)  ----------IAVGLVELECKSWGNKGK----------------------
OsCslA11   (186)  ----------VIKDLVEKECQKWQGKGV----------------------
OsCslA6    (149)  ---------------LVRKECERWGKKGI----------------------
AtCslA1    (20)   ---------------GLDVEIAKWQSQGI----------------------
AtCslA10   (170)  ---------------LVNTECAKWESKGV----------------------
AtCslA15   (159)  ---------------LVSMECTKWASKDI----------------------
AtCslA11   (61)   ---------------MVSTECGKWATKGI----------------------
AtCslA14   (140)  ---------------LVRLECKKWESEGI----------------------
AtCslA3    (168)  ---------------LVNAECDKWARKGI----------------------
AtCslA7    (167)  ---------------LVKKECDRWSKEGV----------------------
AtCslA2    (145)  ---------------MVEVECQRWASKGI----------------------
PoXylS     (145)  ---------------LVEKECLRWASKGI----------------------
OsCslA1    (132)  ---------------MVRIECERWAHKGI----------------------
OsCslA9    (140)  ---------------MVQVECKRWESKGV----------------------
AtCslA9    (145)  ---------------LVEMECSRWASKGI----------------------
PtCslA1    (143)  ---------------LVTMECQRWASKGT----------------------
PtCslA2    (147)  ---------------LVEMECQKWASKGI----------------------
CtManS     (139)  ---------------LVEMECQKWIQKGI----------------------
PpCslA1    (137)  ---------------LQVEVQRWASKGI----------------------
Consensus  (601)           K EYE  VRIE    SK V
```

Figure 5V

```
                  651                                              700
AtCesA1   (479)  ---------------EGWTMQDGTPWPG--------NNTRDHPGMIQVF
AtCesA10  (466)  ---------------DGWTMEDGTSWPG--------NNPRDHPGMIQVF
ZmCesA1   (475)  ---------------EGWTMADGTAWPG--------NNPRDHPGMIQVF
ZmCesA2   (474)  ---------------EGWTMADGTAWPG--------NNPRDHPGMIQVF
ZmCesA3   (469)  ---------------EGWTMADGTPWPG--------NNPRDHPGMIQVF
AtCesA2   (481)  ---------------EGWTMQDGTPWPG--------NNVRDHPGMIQVF
AtCesA9   (486)  ---------------DGWTMQDGTPWPG--------NNVRDHPGMIQVF
AtCesA5   (468)  ---------------EGWTMQDGTPWPG--------NNVRDHPGMIQVF
AtCesA6   (480)  ---------------DGWTMQDGTPWPG--------NSVRDHPGMIQVF
ZmCesA6   (448)  ---------------EGWTMQDGTPWPG--------NNVRDHPGMIQVF
ZmCesA7   (477)  ---------------EGWTMQDGTPWPG--------NNVRDHPGMIQVF
ZmCesA8   (485)  ---------------EGWTMQDGSPWPG--------NNVRDHPGMIQVF
AtCesA3   (463)  ---------------EGWVMQDGTPWPG--------NNTGDHPGMIQVF
ZmCesA4   (478)  ---------------EGWIMQDGTPWPG--------NNTRDHPGMIQVF
ZmCesA9   (480)  ---------------EGWIMQDGTPWPG--------NNTRDHPGMIQVF
ZmCesA5   (477)  ---------------EGWIMQDGTPWPG--------NNTRDHPGMIQVF
AtCesA7   (442)  ---------------EGWIMQDGTPWPG--------NNTKDHPGMIQVF
ZmCesA12  (469)  ---------------EGWIMKDGTPWPG--------NNTRDHPGMIQVF
ZmCesA13  (469)  ---------------EGWIMKDGTPWPG--------NNTRDHPGMIQVF
AtCesA4   (386)  ---------------EGWVMQDGTPWPG--------NNTRDHPGMIQVY
ZmCesA10  (437)  ---------------EGWVMQDGTPWPG--------NNTRDHPGMIQVY
AtCesA8   (388)  ---------------EGWTMQDGTSWPG--------NNTRDHPGMIQVF
ZmCesA11  (386)  ---------------EGWIMQDGTPWPG--------NNPRDHPGMIQVF
AtCslD1   (409)  NGGVLPPDG---VEVVKATWMADGTHWPGTWFEPKPDHSKGDHAGILQIM
AtCslD2   (522)  NRDDEPMEP---VKIPKATWMADGTHWPGTWLTSASDHAKGDHAGIIQVM
AtCslD3   (519)  NRDEEIVEP---VKIPKATWMADGTHWPGTWINSGPDHSRSDHAGIIQVM
OsCslD2   (541)  AALDDVVEA---VKIPKATWMADGTHWPGTWIQPSAEHARGDHAGIIQVM
OsCslD1   (496)  GGDEQQLEP---IKIPKATWMADGTHWPGTWLQASPEHARGDHAGIIQVM
AtCslD4   (497)  -SGGDPTEP---VKVPKATWMADGTHWPGTWAASTREHSKGDHAGILQVM
OsCslD3   (522)  -TGADPSEQ---PKVKKATWMADGSHWPGTWAASAPDHAKGNHAGILQVM
AtCslD5   (547)  --NNPQ-ET---VIVPKATWMSDGSHWPGTWSSGETDNSRGDHAGIIQAM
AtCslD6   (351)  VEEDQIKEPRPALVAPKATWMSDGTHWPGTWAVSGPHHSRGDHASVIQVL
OsCslF7   (283)  -----------------------------------CGAADDHAGVVQVL
OsCslF1   (270)  ----------AKHAGENATWMADGTHWPGTWFEPADNHQRGKHAGIVQVL
OsCslF2   (300)  ----------AKHAGENATWMADGTHWPGTWFEPADNHQRGKHAGIVQVL
OsCslF4   (302)  ----------GKDDGENATWMADGTHWPGTWFEPAENHRKGQHAGIVQVL
OsCslF3   (301)  ----------TDQGAPNATWMANGTQWPGTWIEPIENHRKGHHAGIVKVV
AtCslB1   (176)  ------------------DFEDFSNTK--------PNDHSTIVK--
AtCslB2   (219)  ------------------DFEAFLNTK--------SNDHSTIVK--
AtCslB4   (219)  ------------------ELEAFSNTK--------PNDHSTIIK--
AtCslB3   (220)  ------------------DFEAFSNTK--------PNDHSTLVK--
AtCslB5   (219)  ------------------DFEAFSNTK--------PNDHSTIVK--
AtCslB6   (234)  ------------------DFEAFSNTK--------PNDHSTIVKVL
OsCslH1   (221)  ------------------EFAEFLDVE--------RGNHPTIIKV
OsCslH2   (268)  ------------------FFAEFLNVE--------RRNHPTIVK--
AtCslE1   (234)  ------------------DGFSQWDAD--------ATRRNHGTILQVL
OsCslE1   (225)  ------------------KGFDEWNSD--------FTLKNHQPIVQLI
OsCslE5   (129)  ------------------KGFDGRNSR--------NCLKNHPPIVQVL
AtCslG1   (234)  -----------------FRGVFDLWTDK-------FSRHDHPTIIQVL
AtCslG2   (229)  -----------------FSCVFDLWTDK-------FTRHDHPTIMVL
AtCslG3   (224)  -----------------FRGVFDLWTDK-------FTRHDHPTIIQVL
AtCslC12  (303)  --------------------------------------------
OsCslC1   (295)  --------------------------------------------
```

Figure 5W

```
OsCslC7    (177) --------------------------------------------------
OsCslC9    (200) --------------------------------------------------
AtCslC5    (289) --------------------------------------------------
AtCslC8    (289) --------------------------------------------------
OsCslC3    (323) --------------------------------------------------
OsCslC2    (295) --------------------------------------------------
AtCslC4    (261) --------------------------------------------------
AtCslC6    (283) --------------------------------------------------
OsCslA8    (147) --------------------------------------------------
OsCslA2    (154) --------------------------------------------------
OsCslA4    (174) --------------------------------------------------
OsCslA5    (196) --------------------------------------------------
OsCslA7    (211) --------------------------------------------------
OsCslA3    (237) --------------------------------------------------
OsCslA11   (204) --------------------------------------------------
OsCslA6    (163) --------------------------------------------------
AtCslA1     (34) --------------------------------------------------
AtCslA10   (184) --------------------------------------------------
AtCslA15   (173) --------------------------------------------------
AtCslA11    (75) --------------------------------------------------
AtCslA14   (154) --------------------------------------------------
AtCslA3    (182) --------------------------------------------------
AtCslA7    (181) --------------------------------------------------
AtCslA2    (159) --------------------------------------------------
PoXylS     (159) --------------------------------------------------
OsCslA1    (146) --------------------------------------------------
OsCslA9    (154) --------------------------------------------------
AtCslA9    (159) --------------------------------------------------
PtCslA1    (157) --------------------------------------------------
PtCslA2    (161) --------------------------------------------------
CtManS     (153) --------------------------------------------------
PpCslA1    (151) --------------------------------------------------
Consensus  (651)                         W            H  II V
                 701                                          750
AtCesA1    (505) LGH--------------------SGGLDTDGN--------------E
AtCesA10   (492) LGH--------------------SGGLDTDGN--------------E
ZmCesA1    (501) LGH--------------------SGGLDTDGN--------------E
ZmCesA2    (500) LGH--------------------SGGLDTDGN--------------E
ZmCesA3    (495) LGH--------------------SGGLDTDGN--------------E
AtCesA2    (507) LGH--------------------SGVRDTDGN--------------E
AtCesA9    (512) LGH--------------------SGVCDMDGN--------------E
AtCesA5    (494) LGN--------------------NGVRDVENN--------------E
AtCesA6    (506) LGS--------------------DGVRDVENN--------------E
ZmCesA6    (474) LGQ--------------------SGGHDVEGN--------------E
ZmCesA7    (503) LGQ--------------------SGGLDCEGN--------------E
ZmCesA8    (511) LGQ--------------------SGGRDVEGN--------------E
AtCesA3    (489) LGQ--------------------NGGLDAEGN--------------E
ZmCesA4    (504) LGH--------------------SGGLDTEGN--------------E
ZmCesA9    (506) LGH--------------------SGGLDTEGN--------------E
ZmCesA5    (503) LGH--------------------SGGLDVEGN--------------E
AtCesA7    (468) LGH--------------------SGGFDVEGH--------------E
ZmCesA12   (495) LGH--------------------SGGHDTEGN--------------E
ZmCesA13   (495) LGH--------------------SGGHDTEGN--------------E
AtCesA4    (412) LGK--------------------EGAFDIDGN--------------E
```

Figure 5X

```
ZmCesA10  (463) LGN--------------------QGALDVEGH--------------E
 AtCesA8  (414) LGY--------------------SGARDIEGN--------------E
ZmCesA11  (412) LGE--------------------TGARDFDGN--------------E
 AtCslD1  (456) SKV--------------------PDLEPVMGGPNEG--ALDFTGIDIR
 AtCslD2  (569) LKP--------------------PSDEPLHGVSEG---FLDLTDVDIR
 AtCslD3  (566) LKP--------------------PSDEPLHGVSEG---FLDLTDVDIR
 OsCslD2  (588) LKP--------------------PSDDPLYGTSGEEGRPLDFTEVDIR
 OsCslD1  (543) LKP--------------------PSPSPSSSGGDMEK-RVDLSGVDTR
 AtCslD4  (543) LKP--------------------PSSDPLIGN--SDDKVIDFSDTDTR
 OsCslD3  (568) LKP--------------------PSPDPLYGMH-DDDQMIDFSDVDIR
 AtCslD5  (591) LAP--------------------PNAEPVYGAEADAENLIDTTDVDIR
 AtCslD6  (401) LDP--------------------PGDEPVEGKGGEGR-ALDLEGVDIR
 OsCslF7  (297) IDS--------------------AGSAPQLGVADG-SKLIDLASVDVR
 OsCslF1  (310) LNH--------------------PSCKPRLGLAASAENPVDFSGVDVR
 OsCslF2  (340) LNH--------------------PSCKPRLGLAASAENPVDFSGVDVR
 OsCslF4  (342) LNH--------------------PTSKPRFGVAASVDNPLDFSGVDVR
 OsCslF3  (341) LDH--------------------PIRGHNLSLKDSTGNNLNFNATDVR
 AtCslB1  (194) -------------------------VVWENKGGVGV----------ENE
 AtCslB2  (237) -------------------------VVWENKGGVGD----------EKE
 AtCslB4  (237) -------------------------VVWENKGGVGD----------EKE
 AtCslB3  (238) -------------------------VVWENKGGVGD----------EKE
 AtCslB5  (237) -------------------------VVWENKGGVGD----------EKE
 AtCslB6  (254) LKLFLKTTVRVFVQFSKVMYILKLIIVVWENKGGVGD----------EKE
 OsCslH1  (240) -------------------------L-WDNNRSR-T----------GDG
 OsCslH2  (286) --------------------------------------------------
 AtCslE1  (256) VDG--------------------R---EGNTIA-------------
 OsCslE1  (247) DG---------------------KNRNAIDDDRN-----------V
 OsCslE5  (151) IDG--------------------KSQNVVDDDGN-----------V
 AtCslG1  (258) QNS--------------------ETDMDNTRKY-----------I
 AtCslG2  (253) QHN--------------------ETEM-----------------
 AtCslG3  (248) QNS--------------------ENDMDDTKKY-----------I
AtCslC12  (303) --------------------------------------------------
 OsCslC1  (295) --------------------------------------------------
 OsCslC7  (177) --------------------------------------------------
 OsCslC9  (200) --------------------------------------------------
 AtCslC5  (289) --------------------------------------------------
 AtCslC8  (289) --------------------------------------------------
 OsCslC3  (323) --------------------------------------------------
 OsCslC2  (295) --------------------------------------------------
 AtCslC4  (261) --------------------------------------------------
 AtCslC6  (283) --------------------------------------------------
 OsCslA8  (147) --------------------------------------------------
 OsCslA2  (154) --------------------------------------------------
 OsCslA4  (174) --------------------------------------------------
 OsCslA5  (196) --------------------------------------------------
 OsCslA7  (211) --------------------------------------------------
 OsCslA3  (237) --------------------------------------------------
OsCslA11  (204) --------------------------------------------------
 OsCslA6  (163) --------------------------------------------------
 AtCslA1   (34) --------------------------------------------------
AtCslA10  (184) --------------------------------------------------
AtCslA15  (173) --------------------------------------------------
AtCslA11   (75) --------------------------------------------------
AtCslA14  (154) --------------------------------------------------
```

Figure 5Y

```
AtCslA3    (182) ------------------------------------------------
AtCslA7    (181) ------------------------------------------------
AtCslA2    (159) ------------------------------------------------
 PoXylS    (159) ------------------------------------------------
OsCslA1    (146) ------------------------------------------------
OsCslA9    (154) ------------------------------------------------
AtCslA9    (159) ------------------------------------------------
PtCslA1    (157) ------------------------------------------------
PtCslA2    (161) ------------------------------------------------
 CtManS    (153) ------------------------------------------------
PpCslA1    (151) ------------------------------------------------
Consensus  (701)
                 751                                           800
AtCesA1    (518) LPRLIYVSR-EKRPGFQHHKKAGAMNALI-------------------
AtCesA10   (505) LPRLIYVSR-EKRPGFQHHKKAGAMNALI-------------------
ZmCesA1    (514) LPRLVYVSR-EKRPGFQHHKKAGAMNALI-------------------
ZmCesA2    (513) LPRLVYVSR-EKRPGFQHHKKAGAMNALI-------------------
ZmCesA3    (508) LPRLVYVSR-EKRPGFQHHKKAGAMNALI-------------------
AtCesA2    (520) LPRLVYVSR-EKRPGFDHHKKAGAMNSLI-------------------
AtCesA9    (525) LPRLVYVSR-EKRPGFDHHKKAGAMNSLI-------------------
AtCesA5    (507) LPRLVYVSR-EKRPGFDHHKKAGAMNSLI-------------------
AtCesA6    (519) LPRLVYVSR-EKRPGFDHHKKAGAMNSLI-------------------
ZmCesA6    (487) LPRLVYVSR-EKRPGYNHHKKAGAMNALV-------------------
ZmCesA7    (516) LPRLVYVSR-EKRPGYNHHKKAGAMNALV-------------------
ZmCesA8    (524) LPRLVYVSR-EKRPGYNHHKKAGAMNALV-------------------
AtCesA3    (502) LPRLVYVSR-EKRPGFQHHKKAGAMNALV-------------------
ZmCesA4    (517) LPRLVYVSR-EKRPGFQHHKKAGAMNALV-------------------
ZmCesA9    (519) LPRLVYVSR-EKRPGFQHHKKAGAMNALV-------------------
ZmCesA5    (516) LPRLVYVSR-EKRPGFQHHKKAGAMNALV-------------------
AtCesA7    (481) LPRLVYVSR-EKRPGFQHHKKAGAMNALV-------------------
ZmCesA12   (508) LPRLVYVSR-EKRPGFQHHKKAGAMNALI-------------------
ZmCesA13   (508) LPRLVYVSR-EKRPGFQHHKKAGAMNALI-------------------
AtCesA4    (425) LPRLVYVSR-EKRPGYAHHKKAGAMNAMV-------------------
ZmCesA10   (476) LPRLVYVSR-EKRPGYNHHKKAGAMNALV-------------------
AtCesA8    (427) LPRLVYVSR-EKRPGYQHHKKAGAENALV-------------------
ZmCesA11   (425) LPRLVYVSR-EKRPGYQHHKKAGAMNALV-------------------
AtCslD1    (482) VPMFAYVSR-EKRPGFDHNKKAGAMNGMV-------------------
AtCslD2    (594) LPLLVYVSR-EKRPGYDHNKKAGAMNALV-------------------
AtCslD3    (591) LPLLVYVSR-EKRPGYDHNKKAGAMNALV-------------------
OsCslD2    (616) LPMLVYVSR-EKRPGYDHNKKAGAMNALV-------------------
OsCslD1    (570) LPMLVYVSR-EKRPGYDHNKKAGAMNALV-------------------
AtCslD4    (569) LPMFVYVSR-EKRPGYDHNKKAGAMNALV-------------------
OsCslD3    (595) LPMLVYMSR-EKRPGYDHNKKAGAMNALV-------------------
AtCslD5    (619) LPMLVYVSR-EKRPGYDHNKKAGAMNALV-------------------
AtCslD6    (428) LPMLVYVSR-EKRPGYDHNKKAGAMNALV-------------------
OsCslF7    (324) LPALVYVCR-EKRRGRAHHRKAGAMNALL-------------------
OsCslF1    (338) LPMLVISR-EKRPGYNHQKKAGAMNVML--------------------
OsCslF2    (368) LPMLVYISR-EKRPGYNHQKKAGAMNVML-------------------
OsCslF4    (370) LPMLVYISR-EKRPGYNHQKKAGAMNALL-------------------
OsCslF3    (369) IPMLVYVSR-GKNPNYDHNKKAGALNAQL-------------------
AtCslB1    (208) VPHFVYISR-EKRPNYLHHYKAGAMNFLV-------------------
AtCslB2    (251) VPHVVYISR-EKRPNHFHHYKAGAMNFLV-------------------
AtCslB4    (251) VPHIVYISR-EKRPNYLHHYKAGAMNFLV-------------------
AtCslB3    (252) IPHITYISR-EKRPNYVHNQKCGAMNFLA-------------------
```

Figure 5Z

```
AtCslB5    (251) VPHLVYISR-EKRPNYLHHYKTGAMNFLL-------------------
AtCslB6    (294) VPHLVYISR-EKRPNYLHHYKTGAMNFLVNDFYLTHLSFFDILIYLKINV
OsCslH1    (252) FPRLIYVSR-EKSP-NLHHYKAGAMNAL----------------------
OsCslH2    (286) --------------------------------------------------
AtCslE1    (266) LPTLVYLSR-EKRPQHHHNFKAGAMNALLRVS------------------
OsCslE1    (261) LPTMVYVAR-EKRPQVHHNFKAGALNALIRVS------------------
OsCslE5    (166) LPSLVYMAR-EKRPQVHHNFKSWAMNALICN-------------------
AtCslG1    (272) MPNLIYVSR-EKSVSPHHFKAGALNTLLRVS-------------------
AtCslG2    (260) MPNLIYVSR-EKSVSPHHFKAGALNTLLRVS-------------------
AtCslG3    (262) MPNLIYVSR-EKSVSSHHFKAGALNTLLRVS-------------------
AtCslC12   (303) --RIVYRHR-VNPEGYKAGNLKSAMNCSYVKD------------------
OsCslC1    (295) --RILYRHR-VIRDGYKAGNLKSAMNCSYVKD------------------
OsCslC7    (177) --RIIYRHR-VIRDGYKAGNLKSAMNCSYVKD------------------
OsCslC9    (200) --RIVYRHR-VLRDGYKAGNLKSAMSCSYVKD------------------
AtCslC5    (289) --NIIYRHR-LVRTGYKAGNLKSAMSCDYVEA------------------
AtCslC8    (289) --NIIYRHR-LVRTGYKAGNLKSAMSCDYVEA------------------
OsCslC3    (323) --NILYRHR-LNRTGYKAGNLKSAMSCDYVRD------------------
OsCslC2    (295) --NIVYRHR-VLRTGYKAGNLKSAMSCDYVKD------------------
AtCslC4    (261) --NIIYRHR-LIRTGYKAGNLKSAMTCDYVKD------------------
AtCslC6    (283) --RIVYRHR-LIRTGYKAGNLKAAMNCEYVKD------------------
OsCslA8    (147) --SIRYENR-RNPSGYKAGAMREGLRKAYARE------------------
OsCslA2    (154) --NIKYEVR-NNRKGYKAGALRKGMEHTYAQL------------------
OsCslA4    (174) --NIKIEIR-DNRKGYKAGALKKGMEHIYTQQ------------------
OsCslA5    (196) --NIKIATR-SGRKGFKAGALKKGMEWDYAKQ------------------
OsCslA7    (211) --NIKYVIR-SSRKGFKAGALKKGMECDYTKQ------------------
OsCslA3    (237) --NVKYEVR-NTRKGYKAGALKEGLLRDYVQQ------------------
OsCslA11   (204) --NIKYEVR-GNRKGYKAGALKEGLKHDYVKE------------------
OsCslA6    (163) --NVKYEDR-KDRAGYKAGNLREGMRRGYVQG------------------
AtCslA1    (34)  --NIRCERR-DNRNGYKAGAMKEALTQSYVKQ------------------
AtCslA10   (184) --NIKCERR-DNRNGYKAGALKEGMKHNYVKL------------------
AtCslA15   (173) --NINKERR-ENRNGYKAGALKHGMRHSYVKQ------------------
AtCslA11   (75)  --NIKCERR-DNRNGYKAGALKQGMRHSYVKT------------------
AtCslA14   (154) --TIKSEVRGGFREGRKAGALTAGMKHSYVDEYK----------------
AtCslA3    (182) --NIMSEIR-DNRIGYKAGALKAGMMHNYVKQ------------------
AtCslA7    (181) --NITFEIR-DNRNGYKAGALREGMRHSYVKQ------------------
AtCslA2    (159) --NIRYQIR-ENRVGYKAGALKEGLKRSYVKH------------------
PoXylS     (159) --NIRYQIR-ESRGGYKAGALKEGLKHEYVKP------------------
OsCslA1    (146) --NITYQIR-ENRKGYKAGALKEGMKHGYVRE------------------
OsCslA9    (154) --RIKYEIR-DNRVGYKAGALREGMKHGYVRD------------------
AtCslA9    (159) --NIKYEIR-DNRNGYKAGALKEGMKKSYVKS------------------
PtCslA1    (157) --NIKYEIR-DNRNGYKAGALKEGMKRSYVKD------------------
PtCslA2    (161) --NIKIEIR-GNRNGYKAGALKEGMKHSYVRE------------------
CtManS     (153) --NVKYENR-RNRNGYKAGALKEGLEKQYVED------------------
PpCslA1    (151) --NIKYETR-PNRKGYKAGALRQGMRHPYVQT------------------
Consensus  (751) LP LVYVSR EKRPGY H  KAGAMN LV
                 801                               #    * *    850
AtCesA1    (546) --------------------------------RVSAVLTNGAYLLNVDCDHYFNNSK
AtCesA10   (533) --------------------------------RVSAVLTNGAYLLNVDCDHYFNNSK
ZmCesA1    (542) --------------------------------RVSAVLTNGAYLLNVDCDHYFNSSK
ZmCesA2    (541) --------------------------------RVSAVLTNGAYLLNVDCDHYFNSSK
ZmCesA3    (536) --------------------------------RVSAVLTNGAYLLNVDCDHYFNSSK
AtCesA2    (548) --------------------------------RVSAVLSNAPYLLNVDCDHYINNSK
AtCesA9    (553) --------------------------------RVSAVLSNAPYLLNVDCDHYINNSK
AtCesA5    (535) --------------------------------RVSGVLSNAPYLLNVDCDHYINNSK
```

Figure 5AA

```
AtCesA6   (547) ----------------------------------RVSGVLSNAPYLLNVDCDHYINNSK
ZmCesA6   (515) ----------------------------------RVSAVLTNAPYLLNLDCDHYINNSK
ZmCesA7   (544) ----------------------------------RVSAVLTNAPYLLNLDCDHYINNSK
ZmCesA8   (552) ----------------------------------RVSAVLSNAAYLLNLDCDHYINNSK
AtCesA3   (530) ----------------------------------RVSAVLTNGPFILNLDCDHYINNSK
ZmCesA4   (545) ----------------------------------RVSAVLTNGQYMLNLDCDHYINNSK
ZmCesA9   (547) ----------------------------------RVSAVLTNGQYMLNLDCDHYINNSK
ZmCesA5   (544) ----------------------------------RVSAVLTNGQYMLNLDCDHYINNSK
AtCesA7   (509) ----------------------------------RVAGVLTNAPFMLNLDCDHYVNNSK
ZmCesA12  (536) ----------------------------------RVSAVLTNAPFMLNLDCDHYINNSK
ZmCesA13  (536) ----------------------------------RVSAVLTNAPFMLNLDCDHYINNSK
AtCesA4   (453) ----------------------------------RVSAVLTNAPFMLNLDCDHYINNSK
ZmCesA10  (504) ----------------------------------RVSAVLTNAPFILNLDCDHYVNNSK
AtCesA8   (455) ----------------------------------RVSAVLTNAPFILNLDCDHYVNNSK
ZmCesA11  (453) ----------------------------------RVSAVLTNAPYILNLDCDHYVNNSK
AtCslD1   (510) ----------------------------------RASAILSNGAFILNLDCDHYIYNSK
AtCslD2   (622) ----------------------------------RASAIMSNGPFILNLDCDHYIYNSE
AtCslD3   (619) ----------------------------------RASAIMSNGPFILNLDCDHYIYNSQ
OsCslD2   (644) ----------------------------------RSSAVMSNGPFILNLDCDHYVYNSQ
OsCslD1   (598) ----------------------------------RASAIMSNGPFILNLDCDHYVYNSK
AtCslD4   (597) ----------------------------------RASAILSNGPFILNLDCDHYIYNCK
OsCslD3   (623) ----------------------------------RCSAVMSNGPFMLNFDCDHYINNAQ
AtCslD5   (647) ----------------------------------RTSAIMSNGPFILNLDCDHYIYNSM
AtCslD6   (456) ----------------------------------RASAIMSNGPFILNLDCDHYVYNSR
OsCslF7   (352) ----------------------------------RASAVLSNAPFILNLDCDHYVNNSQ
OsCslF1   (366) ----------------------------------RVSALLSNAPFVINFDGDHYVNNSQ
OsCslF2   (396) ----------------------------------RVSALLSNAPFVINFDGDHYVNNSQ
OsCslF4   (398) ----------------------------------RVSALLSNAPFIINFDCDHYVNNSQ
OsCslF3   (397) ----------------------------------RASALLSNAQFIINFDCDHYINNSQ
AtCslB1   (236) ----------------------------------RVSGLMTNAPYMLNVDCDMYANEAD
AtCslB2   (279) ----------------------------------RVSGLMTNAPYMLNVDCDMYVNEAD
AtCslB4   (279) ----------------------------------RVSGLMTNAPYMLNVDCDMYANEAD
AtCslB3   (280) ----------------------------------RVSGLMTNAPYILNVDCDMYANDAD
AtCslB5   (279) ----------------------------------RVSGLMTNAPYTLNVDCDMYANEPD
AtCslB6   (343) NDCRAVSFCYYDKNMMSLIYNFKQLRVSGLMTNAPYMLNVDCDMYANEPD
OsCslH1   (279) --------------------------TRVSALMTNAPEMLNLDCDMFVNNPR
OsCslH2   (286) --------------------------TRVSAVMTNAPIMLNMDCDMFVNNPQ
AtCslE1   (297) -----------------------------SKITCGKIILNLDCDMYANNSK
OsCslE1   (292) -----------------------------SVISDSPVILNVDCDMYSNNSD
OsCslE5   (196) ---------------------------------NPIILNVDCDMYSNNSD
AtCslG1   (303) -----------------------------GVMTNSPIILTLDCDMYSNDPA
AtCslG2   (291) -----------------------------AVMTNSPIILTLDCDMYSNNPT
AtCslG3   (293) -----------------------------GVMTNSPIILTLDCDMYSNDPA
AtCslC12  (332) ---------------------------------YEFVAIFDADFQ-PLPD
OsCslC1   (324) ---------------------------------YEFVVIFDADFQ-PQAD
OsCslC7   (206) ---------------------------------YEFVVIFDADFQ-PQAD
OsCslC9   (229) ---------------------------------YEFVAIFDADFQ-PNPD
AtCslC5   (318) ---------------------------------YEYVAIFDADFQ-PTPD
AtCslC8   (318) ---------------------------------YEFVAIFDADFQ-PNSD
OsCslC3   (352) ---------------------------------YEFVAIFDADFQ-PNPD
OsCslC2   (324) ---------------------------------YEFVAIFDADFQ-PTPD
AtCslC4   (290) ---------------------------------YEFVTIFDADFT-PNPD
AtCslC6   (312) ---------------------------------YEFVAIFDADFQ-PPAD
OsCslA8   (176) ---------------------------------CELVAIFDADFQ-PDAD
```

Figure 5BB

```
OsCslA2     (183) ----------------------------------CDFVAIFDADFE-PESD
OsCslA4     (203) ----------------------------------CDFVAIFDADFQ-PESD
OsCslA5     (225) ----------------------------------CEYVAIFDADFQ-PEPD
OsCslA7     (240) ----------------------------------CEYLAIFDADFQ-PEPN
OsCslA3     (266) ----------------------------------CNYVAIFDADFQ-PEPD
OsCslA11    (233) ----------------------------------CEYIAMFDADFQ-PESD
OsCslA6     (192) ----------------------------------CEFVAMIDADFQ-PPPD
AtCslA1      (63) ----------------------------------CDFVAVFDADFQ-PEPD
AtCslA10    (213) ----------------------------------CNYVVIFDADFQ-PEPD
AtCslA15    (202) ----------------------------------CQYIAIFDADFQ-PEPD
AtCslA11    (104) ----------------------------------CTYIAIFDADFQ-PEPD
AtCslA14    (186) ----------------------------------CEFVVIFDADFQ-PEPD
AtCslA3     (211) ----------------------------------CEFVAIFDADFQ-PDPD
AtCslA7     (210) ----------------------------------CDYVAIFDADFQ-PDPD
AtCslA2     (188) ----------------------------------CEYVVIFDADFQ-PEPD
PoXylS      (188) ----------------------------------CEYVVIFDADFR-PEPD
OsCslA1     (175) ----------------------------------CEYVAIFDADFQ-PDPD
OsCslA9     (183) ----------------------------------CDYVAIFDADFQ-PDPD
AtCslA9     (188) ----------------------------------CDYVAIFDADFQ-PEAD
PtCslA1     (186) ----------------------------------CDYVAIFDADFQ-PEPD
PtCslA2     (190) ----------------------------------CDYVVIFDADFQ-PDRD
CtManS      (182) ----------------------------------CEFVAIFDADFQ-PDAD
PpCslA1     (180) ----------------------------------CDYVAIFDADFQ-PEPE
Consensus   (801)                                    R SAVLTNA YVLNLDCD Y NNS
                  851                                                      900
AtCesA1     (571) AIKEAMCFMMDPAIG-----KKCCYVQFPQRFDGIDLHDRYANRNIVFFD
AtCesA10    (558) AIKEAMCFMMDPAIG-----KKCCYVQFPQRFDGIDLHDRYANRNTVFFD
ZmCesA1     (567) ALREAMCFMMDPALG-----RKTCYVQFPQRFDGIDLHDRYANRNIVFFD
ZmCesA2     (566) ALREAMCFMMDPALG-----RKTCYVQFPQRFDGIDLHDRYANRNIVFFD
ZmCesA3     (561) ALREAMCFMMDPALG-----RKTCYVQFPQRFDGIDLHDRYANRNIVFFD
AtCesA2     (573) AIRESMCFMMDPQSG-----KKVCYVQFPQRFDGIDRHDRYSWRNVVFFD
AtCesA9     (578) AIREAMCFMMDPQSG-----KKICYVQFPQRFDGIDRHDRYSWRNVVFFD
AtCesA5     (560) ALREAMCFMMDPQSG-----KKICYVQFPQRFDGIDKSDRYSWRNVVFFD
AtCesA6     (572) ALREAMCFMMDPQSG-----KKICYVQFPQRFDGIDRHDRYSWRNVVFFD
ZmCesA6     (540) AIKEAMCFMMDPLLG-----KKVCYVQFPQRFDGIDRHDRYANRNVVFFD
ZmCesA7     (569) AIKEAMCFMMDPLLG-----KKVCYVQFPQRFDGIDRHDRYANRNVVFFD
ZmCesA8     (577) AIKEAMCFMMDPLVG-----KKVCYVQFPQRFDGIDKNDRYANRNVVFFD
AtCesA3     (555) ALREAMCFLMDPNLG-----KQVCYVQFPQRFDGIDKNDRYANRNTVFFD
ZmCesA4     (570) ALREAMCFLMDPNLG-----RSVCYVQFPQRFDGIDRNDRYANRNTVFFD
ZmCesA9     (572) ALREAMCFLMDPNLG-----RSVCYVQFPQRFDGIDRNDRYANRNVVFFD
ZmCesA5     (569) ALREAMCFLMDPNLG-----RNVCYVQFPQRFDGIDRNDRYANRNTVFFD
AtCesA7     (534) AVREAMCFLMDPQIG-----KKVCYVQFPQRFDGIDTNDRYANRNTVFFD
ZmCesA12    (561) AIREAMCFLMDPQVG-----RKVCYVQFPQRFDGIDVHDRYANRNTVFFD
ZmCesA13    (561) AIREAMCFLMDPQVG-----RKVCYVQFPQRFDGIDMHDRYANRNTVFFD
AtCesA4     (478) AIRESMCFLMDPQLG-----KKLCYVQFPQRFDGIDLNDRYANRNIVFFD
ZmCesA10    (529) AVREAMCFLMDPQLG-----KKLCYVQFPQRFDGIDRHDRYANRNVVFFD
AtCesA8     (480) AVREAMCFLMDPVVG-----QDVCFVQFPQRFDGIDKSDRYANRNIVFFD
ZmCesA11    (478) AVREAMCFMMDPTVG-----RDVCYVQFPQRFDGIDRSDRYANRNVVFFD
AtCslD1     (535) AIKEGMCFMMDRGGD-----RICYIQFPQRFEGIDPSDRYANHNTVFFD
AtCslD2     (647) ALREGMCFMMDRGGD-----RICYVQFPQRFEGIDPSDRYANHNTVFFD
AtCslD3     (644) ALREGMCFMMDRGGD-----RICYVQFPQRFEGIDPSDRYANHNTVFFD
OsCslD2     (669) AFREGMCFMMDRGGD-----RIGYVQFPQRFEGIDPSDRYANHNTVFFD
OsCslD1     (623) AFREGMCFMMDRGGD-----RLCYVQFPQRFEGIDPSDRYANHNTVFFD
AtCslD4     (622) AVREGMCFMMDRGGE-----DICYIQFPQRFEGIDPSDRYANNNTVFFD
```

Figure 5CC

```
OsCslD3    (648)  AVREAMCFEMDRGGE------RIAYIQFPQRFEGIDPSDRYANNNTVFFD
AtCslD5    (672)  ALREGMCFMLDRGGD------RLCYVQFPQRFEGIDPNDRYAHNTVFFD
AtCslD6    (481)  AFRDGICFMMDHDGD------RVSYVQFPQRFEGIDPSDRYAKNTVFFD
OsCslF7    (377)  ALRAGICFMIERRGGGAEDAGDVAFVQFPQRFDGVDPGDRYANHNRVFFD
OsCslF1    (391)  AFRAPMCFMLDGRGR---GGENTAFVQFPQRFDDVDPTDRYANHNRVFFD
OsCslF2    (421)  AFRAPMCFMLDGRGR---GGENTAFVQFPQRFDDVDPTDRYANHNRVFFD
OsCslF4    (423)  AFRAPMCFMLDRRG----GGDDVAFVQFPQRFDDVDPTDRYANHNRVFFD
OsCslF3    (422)  AFRAAICFMLDQRE-----GDNTAFVQFPQRFDNVDPKDRYGNHNRVFFD
AtCslB1    (261)  VVRQAMCIFLQKSMNSN----HCAFVQFPQEFY-----DSNADELTVLQS
AtCslB2    (304)  VVRQAMCIFLQKSMDSN----HCAFVQYPQDFY-----DSNVGELTVLQL
AtCslB4    (304)  VVRQAMCIFLQKSQNQN----HCAFVQFPQEFY-----DSNTIKLTVIKS
AtCslB3    (305)  VVRQAMCILLQESLNMK----HCAFVQFRQEFY-----DSSTELIVVLQS
AtCslB5    (304)  VVRQAMCVFLQNSKNSN----HCAFVQFPQKFY-----DSYTNELAVLQS
AtCslB6    (393)  VVRQAMCVFLQNSKNSN----HCAFVQFPQNFY-----DSYTNELVVLQH
OsCslH1    (305)  VVLHAMCLLLG-FDDEI----SCAFVQTPQKFYGALKDDPFGNQLEVSLM
OsCslH2    (312)  AVLHAMCLLLG-FDDEA----SSGFVQAPQREYDALKDDPFGNQMECFFK
AtCslE1    (319)  STRDALCILLDEKEG-----KEIAFVQFPQCEDNVTRNDLLGSMMRVGID
OsCslE1    (314)  SIRDALCFFLDEEMG-----QKIGFVQYPQIFNNMTQNDIYGNSFNVSYH
OsCslE5    (213)  SIRGTLCFFLDEEMG-----HKIGFVQ-PQLYN-MTKNNIYGNSLLVLNE
AtCslG1    (325)  TLVRALCYITTPEIK-----SGLGYVQFPQKFLGISKNDIYACENKRLFI
AtCslG2    (313)  TPLHALCYLSDPKIN-----FDLGFVQFPQKFQGVNKNDIYASELKRPFL
AtCslG3    (315)  TPVRALCYLTDPKIK-----TGLGFVQFPQTFQGISKNDIYACAYKRLFE
AtCslC12   (348)  FLKKTIPHFKDNEE-------IGLVQARWSFVNKD-----ENLLTRLQN
OsCslC1    (340)  FLKRTVPHFKGNED-------VGLVQARWSFVNKD-----ENLLTRLQN
OsCslC7    (222)  FLKRTVPHFKGKDD-------VGLVQARWSFVNKD-----ENLLTRLQN
OsCslC9    (245)  FLKRTVPHFKDNDE-------LGLVQARWSFVNKD-----ENLLTRLQN
AtCslC5    (334)  FLKLTVPHFKDNPE-------LGLVQARWTFVNKD-----ENLLTRLQN
AtCslC8    (334)  FLKLTVPHFKEKPE-------LGLVQARWAFVNKD-----ELLLTRLQN
OsCslC3    (368)  FLKLTVPHFKGNPE-------LGLVQARWSFVNKD-----ENLLTRLQN
OsCslC2    (340)  FLKKTIPHFEGNPE-------LGLVQARWSFVNKD-----ENLLTRLQN
AtCslC4    (306)  FLKKTVPHFKGNPE-------LGLVQARWSFVNKD-----ELLLTRLQN
AtCslC6    (328)  FLKKTVPHFKGNEE-------LALVQTRWAFVNKD-----ENLLTRLQN
OsCslA8    (192)  FLLRTVPVLADPG--------VALVQARWKFVNAD-----ECLLTRIQE
OsCslA2    (199)  FLLKTMPYLLHNPK--------IALVQTRWEFVNYN-----VCLMTRIQK
OsCslA4    (219)  FLLKTIPFLVHNPK--------IGLVQTRWEFVNYT-----VCLMTRIQK
OsCslA5    (241)  FLLRTVPFLMHNQN--------VALVQARWVFVNDR-----VSLLTRIQK
OsCslA7    (256)  FLLRTVPFLMHNPN--------VALVQARWAFVNDT-----TSLLTRVQK
OsCslA3    (282)  FLLRTIPYLVRNPQ--------IGLVQAHWEFVNTS-----ECLMTRIQK
OsCslA11   (249)  FLLRTVPFLVHNSE--------LALVQTRWKFVNAN-----ECLLTRFQE
OsCslA6    (208)  FLLKTVPFLVHNPR--------LALVQTRWEFVNAN----DCLLTRMQE
AtCslA1     (79)  YLIRAVPFLVHNPD--------VALVQARWIFVNAN-----KCLMTRMQE
AtCslA10   (229)  YLQHSVPFLVHNPE--------VALVQARWRFMNAN-----KCLMTRMQE
AtCslA15   (218)  YLQRAIPFLIHNPE--------VALVQARWRFVNAN-----TCLMTRMQE
AtCslA11   (120)  YLERTVPFLIHNPE--------LALVQARWKFVNAK-----KCLMTRMQE
AtCslA14   (202)  FLERTVPFLVHNPE--------IALVQAGWKYGNAD-----ECCMTRIQE
AtCslA3    (227)  FLERTIPFLIHNHE--------ISLVQCRWKFVNAN-----ECLMTRMQE
AtCslA7    (226)  FLHRTVPFLIHNPK--------LALVQGRWEFVNAG-----QCMMTRLQE
AtCslA2    (204)  FLRRSIPFLMHNPN--------IALVQARWRFVNSD-----ECLLTRMQE
PoXylS     (204)  FLKRAVPFLIHNKD--------IALVQSRWRFVNSD-----ECLLTRMQE
OsCslA1    (191)  FLRRTIPFLVHNSD--------IALVQARWKFVNAD-----ECLMTRMQE
OsCslA9    (199)  FLARTIPFLVHNPD--------IALVQARWKFVNAN-----ECLMTRMQE
AtCslA9    (204)  FLWRTVPYLLHNPK--------LALVQARWKFVNSD-----ECLMTRMQE
PtCslA1    (202)  YLWRTVPFLVHNPE--------LALVQARWKFVNSD-----ECLMTRMQE
PtCslA2    (206)  FLSRTIPFLVHNPE--------LALVQARWKFVNAD-----ECLMTRMQE
```

Figure 5DD

```
CtManS       (198) FLWNTIPYLLENPK--------LGLVQARWKFVNSE------ECMMTRLQE
PpCslA1      (196) FLQRTVPFLVHNSN--------LALVQARWKFVNAN------ECLMTKMQE
Consensus    (851) LR AMCFLMD            VAYVQFPQRF   ID  D Y N LTV  D
                   901                                              950
AtCesA1      (616) INMKGLDGIQGPVYVGTGCCFNRQALYGYDPVLTEEDLE------PNIIV
AtCesA10     (603) ENLKGLDGIQGPVYVGTGCCFNRQALYGYDPVLTEEDLE------PNIIV
ZmCesA1      (612) INMKGLDGIQGPVYVGTGCCFNRQALYGYDPVLTEADLE------PNIVI
ZmCesA2      (611) INMKGLDGIQGPVYVGTGCCFNRQALYGYDPVLTEADLE------PNIVV
ZmCesA3      (606) INMKGLDGIQGPVYVGTGCCFNRQALYGYDPVLTEADLE------PNIII
AtCesA2      (618) INMKGLDGIQGPIYVGTGCVFRRQALYGFDAPKKKKPPGKTCNCWPKWCC
AtCesA9      (623) INMKGLDGIQGPIYVGTGCVFRRQALYGFDAPKKKQPPGRTCNCWPKWCC
AtCesA5      (605) INMKGLDGLQGPIYVGTGCVFRRQALYGFDAPKKKKTKRMTCNCWPKWCL
AtCesA6      (617) INMKGLDGLQGPIYVGTGCVFRRQALYGFDAPKKKKGPRKTCNCWPKWCL
ZmCesA6      (585) INMKGLDGIQGPIYVGTGCVFRRQALYGYDAPKTKKPPSRTCNCWPKWCI
ZmCesA7      (614) INMKGLDGIQGPIYVGTGCVFRRQALYGYDAPKTKKPPSRTCNCWPKWCF
ZmCesA8      (622) INMKGLDGIQGPIYVGTGCVFRRQALYGYDAPKTKKPPSRTCNCWPKWCL
AtCesA3      (600) INLRGLDGIQGPVYVGTGCVFNRTALYGYEPPIKVKHKK------PSLLS
ZmCesA4      (615) INLRGLDGIQGPVYVGTGCVFNRTALYGYEPPIKQKK--------GGFLS
ZmCesA9      (617) INLRGLDGIQGPVYVGTGCVFNRTALYGYEPPIKQKK--------GGFLS
ZmCesA5      (614) INLRGLDGIQGPVYVGTGCVFNRTALYGYEPPVKKKK--------PGFFS
AtCesA7      (579) INMKGLDGIQGPVYVGTGCVFKRQALYGYEPPKGPKR--------PKMIS
ZmCesA12     (606) INMKGLDGIQGPVYVGTGCVFRRQALYGYNPPKGPKR--------PKMVT
ZmCesA13     (606) INMKGLDGIQGPVYVGTGCVFRRQALYGYNPPKGPKR--------PKMVT
AtCesA4      (523) INMRGLDGIQGPVYVGTGCVFNRPALYGYEPPVSEKRKKMTCDCWPSWIC
ZmCesA10     (574) INMKGLDGIQGPVYVGTGCVFNRQALYGYDPPRPEKRPKMTCDCWPSWCC
AtCesA8      (525) VNMRGLDGIQGPVYVGTGTVFRRQALYGYSPPSKPRILP------QSSSS
ZmCesA11     (523) VNMKGLDGLQGPVYVGTGCCFNRQALYGYGPPSLPALPK------SSICS
AtCslD1      (579) GNMRALDGLQGPVYVGTGCMFRYALYGFNPPRANEYSGVFGQE-----K
AtCslD2      (691) VNMRALDGIMGPVYVGTGCLFRRIALYGFNPPRSKDFSPSCWS------C
AtCslD3      (688) VNMRALDGIMGPVYVGTGCLFRRIALYGFDPPRAKEHHPGFCS------C
OsCslD2      (713) VNMRALDGIMGPVYVGTGCLFRRIALYGFDPPRSKEHSGCCSC------C
OsCslD1      (667) VNMRALDGLQGPVYVGTGCLFRRIALYGFDPPRSKDHTTPWSC------C
AtCslD4      (666) GNMRALDGVQGPVYVGTGTMFRRFALYGFDPPN-----------------
OsCslD3      (692) GNMRALDGLQGPMYVGTGCMFRRFAVYGFDPPRSAEYTGWLFT------K
AtCslD5      (716) VSMRALDGLQGPMYVGTGCIFRRTALYGFSPPRATEHHGWLGRRKVKISL
AtCslD6      (525) INLRALDGIQGPMYVGTGCLFRRTALYGFNPPDVFVVEEEPSGS-----Y
OsCslF7      (427) CTELGLDGLQGPIYVGTGCLFRRVALYGVDPPRWR---------------
OsCslF1      (438) GTMLSLNGLQGPSYLGTGTMFRRVALYGVEPPRWGA--------------
OsCslF2      (468) GTMLSLNGLQGPSYLGTGTMFRRVALYGVEPPRWGA--------------
OsCslF4      (469) GTTLSLNGLQGPSYLGTGTMFRRAALYGLEPPRWGA--------------
OsCslF3      (467) GTMLALNGLQGPSYLGTGCMFRRLALYGIDPPHW----------------
AtCslB1      (302) YLGRGIAGIQGPTIAGSGCFHTRRVMYGLSIDDLEDDGS-----------
AtCslB2      (345) YLGRGIAGIQGPQYAGSGCFHTRRVMYGLSLDDLGDDGS-----------
AtCslB4      (345) YMGRGIAGIQGPINVGSGCFHSRRVMYGLSPDELEDNGS-----------
AtCslB3      (346) HLGRGIAGIQGPIYIGSGCVHTRRVMYGLSPDDFEVDGS-----------
AtCslB5      (345) ILGRGVAGIQGPFYIGTGCFHTRRVMYGLSSDDLEDNGN-----------
AtCslB6      (434) YMKRGVAGIQGPIYIGSGCFHTRRVMYGLSSDDLEDDGS-----------
OsCslH1      (350) KVGRGIAGLQCIFYCGTGCFHRRKVIYGMRTG------------------
OsCslH2      (357) RFISGVQGVQGAFYAGTGCFHRRKAVYGVPPNFNGAE-------------
AtCslE1      (364) VEFLGLDGNGGPLYIGTGCFHRRDVICGRKYG------------------
OsCslE1      (359) VEMCGLDSVGGCLYIGTGCFHRREILCQRIFS------------------
OsCslE5      (256) VSCIKLPIHN----IGTGRFHIREILCVGGSA------------------
AtCslG1      (370) INMVGFDGLMGPTHVGTGCFFNRRAFYGPPYM-------------------
AtCslG2      (358) INTVGFDGIMGPVHMGTGCFFNRRAFYGPPTT-------------------
```

Figure 5EE

```
AtCslG3     (360) INMIGFDGLMGPNHVGTGCFFNRRGFYGAPSN------------------
AtCslC12    (385) INLAFHFEVEQQVNSVFLNFFGFNGTAGVWRIKALE---------------
OsCslC1     (377) INLCFHFEVEQQVNGVFLNFFGFNGTAGVWRIKALE---------------
OsCslC7     (259) VNLCFHFEVEQQVNGAFLNFFGFNGTAGVWRIKALE---------------
OsCslC9     (282) INLCFHFEVEQQVNGIFLNFFGFNGTAGVWRIKALD---------------
AtCslC5     (371) INLCFHFEVEQQVNGVFLNFFGFNGTAGVWRIKALE---------------
AtCslC8     (371) INLCFHFEVEQQVNGVFLNFFGFNGTAGVWRIKALE---------------
OsCslC3     (405) INLCFHFEVEQQVNGVYLSFFGFNGTAGVWRIKALE---------------
OsCslC2     (377) INLCFHFEVEQQVNGVFLNFFGFNGTAGVWRIQALE---------------
AtCslC4     (343) INLCFHFEVEQQVNGVFLNFFGFNGTAGVWRIKALE---------------
AtCslC6     (365) INLSFHFEVEQQVNGVFINFFGFNGTAGVWRIKALE---------------
OsCslA8     (229) MSLDYHFRVEQEVGSACHGFFGFNGTAGVWRVRALE---------------
OsCslA2     (236) MSLDYHFKVEQESGSFMHAFFGFNGTAGVWRVSAIN---------------
OsCslA4     (256) MSLDYHFKVEQESGSSMHSFFGFNGTAGVWRVSAIN---------------
OsCslA5     (278) TFLDYHFKAEQEAGSATFAFFSFNGTAGVWRTEAIN---------------
OsCslA7     (293) MFFDYHFKVEQEAGSATFAFFSFNGTAGVWRTTAIN---------------
OsCslA3     (319) MTLHYHFKVEQEGGSSLFAFFGFNGTAGVWRISALE---------------
OsCslA11    (286) MSLDYHFKYEQEAGSSVYSFFGFNGTAGVWRIAAID---------------
OsCslA6     (245) MSMDYHFKVEQEAGSSLCNFFGYNGTAGVWRRQVID---------------
AtCslA1     (116) MSLNYHFKVEQESGSTRHAFFGFNGTAGVWRISAME---------------
AtCslA10    (266) MSLNYHFMAEQESGSTRHAFFSFNGTAGVWRMAAME---------------
AtCslA15    (255) MSLNYHFMAEQQSGSTRHAFFGFNGTAGVWRMVAME---------------
AtCslA11    (157) MSLNYHFTAEQESGSTRHAFFGFNGTAGVWRLAAME---------------
AtCslA14    (239) MSLNYHFAVEQKSGSSILGFFGFNGTAGVWRIKALN---------------
AtCslA3     (264) MSLNYHFVAEQESGSSIHAFFGFNGTAGVWRIAALN---------------
AtCslA7     (263) MSLSYHFTFEQQVGSSTFAFFGFNGTAGVWRISALN---------------
AtCslA2     (241) MSLDYHFTVEQEVGSSTHAFFGFNGTAGIWRIAAIN---------------
PoXylS      (241) MSLDYHFTVEQEVGSATHAFFGFNGTGGIWRIKAIN---------------
OsCslA1     (228) MSLDYHFTVEQEVSSSVCAFFGFNGTAGVWRVSAVN---------------
OsCslA9     (236) MSLDYHFKVEQEVGSSTHAFFGFNGTAGVWRISAMN---------------
AtCslA9     (241) MSLDYHFTVEQEVGSSTYAFFGFNGTAGIWRISALN---------------
PtCslA1     (239) MSLDYHFTVEQEVGSSTHAFFGFNGTAGVWRINALN---------------
PtCslA2     (243) MSLDYHFTVEQEVGSATHAFFGFNGTAGVWRIKALN---------------
CtManS      (235) MSLDYHFSVEQEVGSSIYSFFGFNGTAGVWRIQAIK---------------
PpCslA1     (233) VSLNYHFSVEQRVGSATYGFFGFNGTAGVWRIRAME---------------
Consensus   (901) INL GL GVQGPVYVGTGCFF RNALYGV
                  951                                                1000
AtCesA1     (660) KSCCGSRKKG---KSSKKYNY----------------------------EK
AtCesA10    (647) KSCFGSRKKG---KSRKIPNY----------------------------ED
ZmCesA1     (656) KSCCGRRKK-----KNKSYMD----------------------------SQ
ZmCesA2     (655) KSCCGRRKR-----KNKSYMD----------------------------SQ
ZmCesA3     (650) KSCCGGRKK-----KDKSYID----------------------------SK
AtCesA2     (668) LCCGLRKKS--------KTKA----------------------------KD
AtCesA9     (673) LCCGMRKKK--------TGKV----------------------------KD
AtCesA5     (655) FCCGLRKNR--------KSKT----------------------------TD
AtCesA6     (667) LCFGSRKNRK------AKTVA----------------------------AD
ZmCesA6     (635) CCCCFGNRKTKKKTKTSKPKF----------------------------EK
ZmCesA7     (664) CCCCFGNR---KQKKTTKPKT----------------------------EK
ZmCesA8     (672) SCCCSRNK---NKKKTTKPKT----------------------------EK
AtCesA3     (644) KLCGGSRKKN---SKAKKESD----------------------------KK
ZmCesA4     (657) SLCGG-RKKA---SKSKKGSD----------------------------KK
ZmCesA9     (659) SLCGG-RKKG---SKSKKGSD----------------------------KK
ZmCesA5     (656) SLCGG-RKKT---SKSKKSSE----------------------------KK
AtCesA7     (621) CGCCPCFGRR---RKNKK-------------------------------
```

Figure 5FF

```
ZmCesA12   (648)  CDCCPCFGRK---KRK-----------------------------------
ZmCesA13   (648)  CDCCPCFGRK---KRK-----------------------------------
 AtCesA4   (573)  CCCGGGN-RNHKSDSSKKKSG----IKSLFSKLKKKTKKKSDDKTMSSYS
ZmCesA10   (624)  CCCCFGGGKRGKARKDKKGDGGEEPRRGLLGFYRKRSKKDKLGGGSVAGS
 AtCesA8   (569)  SCCCLTKKKQPQ---------------------------------------
ZmCesA11   (567)  WCCCCCPKKKVER--------------------------------------
 AtCslD1   (624)  APAMHVRTQSQ-------------------------------------ASQ
 AtCslD2   (735)  CFPRSKKKN---------------------------------------IPE
 AtCslD3   (732)  CFSRKKKKSR--------------------------------------VPE
 OsCslD2   (757)  FPQRRKVKTS--------------------------------------TVA
 OsCslD1   (711)  LPRRRRTRSQP-------------------------------------QPQ
 AtCslD4   (699)  -PDKLLEKKE-----------------------------------------
 OsCslD3   (736)  KKVTTFKDPE-----------------------------------------
 AtCslD5   (766)  RRPKAMMKKDD-------------------------------------EVS
 AtCslD6   (570)  CFPLIKKRSP-----------------------------------------
 OsCslF7   (462)  ---------------------------------------------------
 OsCslF1   (474)  ---------------------------------------------------
 OsCslF2   (504)  ---------------------------------------------------
 OsCslF4   (505)  ---------------------------------------------------
 OsCslF3   (501)  ---------------------------------------------------
 AtCslB1   (341)  ---------------------------------------------------
 AtCslB2   (384)  ---------------------------------------------------
 AtCslB4   (384)  ---------------------------------------------------
 AtCslB3   (385)  ---------------------------------------------------
 AtCslB5   (384)  ---------------------------------------------------
 AtCslB6   (473)  ---------------------------------------------------
 OsCslH1   (382)  ---------------------------------------------------
 OsCslH2   (394)  ---------------------------------------------------
 AtCslE1   (396)  ---------------------------------------------------
 OsCslE1   (391)  ---------------------------------------------------
 OsCslE5   (284)  ---------------------------------------------------
 AtCslG1   (402)  ---------------------------------------------------
 AtCslG2   (390)  ---------------------------------------------------
 AtCslG3   (392)  ---------------------------------------------------
AtCslC12   (421)  ---------------------------------------------------
 OsCslC1   (413)  ---------------------------------------------------
 OsCslC7   (295)  ---------------------------------------------------
 OsCslC9   (318)  ---------------------------------------------------
 AtCslC5   (407)  ---------------------------------------------------
 AtCslC8   (407)  ---------------------------------------------------
 OsCslC3   (441)  ---------------------------------------------------
 OsCslC2   (413)  ---------------------------------------------------
 AtCslC4   (379)  ---------------------------------------------------
 AtCslC6   (401)  ---------------------------------------------------
 OsCslA8   (265)  ---------------------------------------------------
 OsCslA2   (272)  ---------------------------------------------------
 OsCslA4   (292)  ---------------------------------------------------
 OsCslA5   (314)  ---------------------------------------------------
 OsCslA7   (329)  ---------------------------------------------------
 OsCslA3   (355)  ---------------------------------------------------
OsCslA11   (322)  ---------------------------------------------------
 OsCslA6   (281)  ---------------------------------------------------
 AtCslA1   (152)  ---------------------------------------------------
AtCslA10   (302)  ---------------------------------------------------
```

Figure 5GG

```
AtCslA15   (291) --------------------------------------------------
AtCslA11   (193) --------------------------------------------------
AtCslA14   (275) --------------------------------------------------
AtCslA3    (300) --------------------------------------------------
AtCslA7    (299) --------------------------------------------------
AtCslA2    (277) --------------------------------------------------
PoXylS     (277) --------------------------------------------------
OsCslA1    (264) --------------------------------------------------
OsCslA9    (272) --------------------------------------------------
AtCslA9    (277) --------------------------------------------------
PtCslA1    (275) --------------------------------------------------
PtCslA2    (279) --------------------------------------------------
CtManS     (271) --------------------------------------------------
PpCslA1    (269) --------------------------------------------------
Consensus  (951)
                 1001                                           1050
AtCesA1    (680) RRGINRSDSNAPLFNMEDIDEGFEG--YDDERSILMSQRSVEKRFGQSPV
AtCesA10   (667) NRSIKRSDSNVPLFNMEDIDEDVEG--YEDEMSLLVSQKRLEKRFGQSPV
ZmCesA1    (674) SRIMKRTESSAPIFNMEDIEEGIEG--YEDERSVLMSQRKLEKRFGQSPI
ZmCesA2    (673) SRIMKRTESSAPIFNMEDIEEGIEG--YEDERSVLMSQRKLEKRFGQSPI
ZmCesA3    (668) NRDMKRTESSAPIFNMEDIEEGFEG--YEDERSLLMSQKSLEKRFGQSPI
AtCesA2    (683) KKTN-TKETSKQIHALENVDEGVIVPVSNVEKRSEATQLKLEKKFGQSPV
AtCesA9    (688) NQRKKPKETSKQIHALEHIEEGLQVTNAEN--NSETAQLKLEKKFGQSPV
AtCesA5    (670) KKKK-NREASKQIHALENIEEG-TKGTNDAAKSPEAAQLKLEKKFGQSPV
AtCesA6    (684) KKKK-NREASKQIHALENIEEGRVTKGSNVEQSTEAMQMKLEKKFGQSPV
ZmCesA6    (658) IKKLFKKKE-NQAPAYALGEIDEAAPGAENEKASIVNQQKLEKKFGQSSV
ZmCesA7    (684) KKLLFFKKEENQSPAYALGEIDEAAPGAENEKAGIVNQQKLEKKFGQSSV
ZmCesA8    (692) KKRLFFKKAENPSPAYALGEIDEGAPGADIEKAGIVNQQKLEKKFGQSSV
AtCesA3    (664) -KSGRHTDSTVPVFNLDDIEEGVEGAGFDDEKALLMSQMSLEKRFGQSAV
ZmCesA4    (676) -KSQKHVDSSVPVFNLEDIEEGVEGAGFDDEKSLLMSQMSLEKRFGQSAA
ZmCesA9    (678) -KSQKHVDSSVPVFNLEDIEEGVEGAGFDDEKSLLMSQMSLEKRFGQSAA
ZmCesA5    (675) -KSHRHADSSVPVFNLEDIEEGIEGSQFDDEKSLIMSQMSLEKRFGQSSV
AtCesA7    (636) ------------FSKNDMNGDVAALGGAEGDKEHLMFEMNFEKTFGQSSI
ZmCesA12   (661) ------------HAKDGLPEGTADMGVDSDKEMLMSHMNFEKRFGQSAA
ZmCesA13   (661) ------------DAKDGLPEGTADIGVDSDKEMLMSQMNFEKRFGQSAA
AtCesA4    (618) RKRS----STEAIFDLEDIEGLEG-YDELEKSSLMSQKNFEKRFGMSPV
ZmCesA10   (674) KKGGGLYKKHQRAFELEEIEGLEG-YDELERSSLMSQKSFEKRFGQSPV
AtCesA8    (581) DPAEIYKDAKREELDAAIFNLGDLDNYDEYDRSMLISQTSFEKTFGLSTV
ZmCesA11   (580) SEREINRDSRREDLESAIFNLREIDNYDEYERSMLISQMSFEKSFGLSSV
AtCslD1    (638) TSQASDLESDTQPLNDDPDLGLPKKFGNSTMFTDTIPVAEYQGRPLADHM
AtCslD2    (747) ENRALRMS--DYDDEEMNLSLVPKKFGNSTFLIDSIPVAEFQGRPLADHP
AtCslD3    (745) ENRSLRMGGDSDDDEEMNLSLVPKKFGNSTFLIDSIPVAEFQGRPLADHP
OsCslD2    (770) SEERQALRMADFDDEEMNMSQFPKKFGNSNFLINSIPIAEFQGRPLADHP
OsCslD1    (725) EEEEETMALRMDMDGAMNMASFPKKFGNSSFLIDSIPVAEFQGRPLADHP
AtCslD4    (708) -S-ETEALTTSDFDPDLDVTQLPKRFGNSTLLAESIPIAEFQGRPLADHP
OsCslD3    (746) -S-DTQTLKAEDFDAELTSHLVPRRFGNSSPFMASIPVAEFQARPLADHP
AtCslD5    (780) LPINGEYNEEENDDGDIESLLLPKRFGNSNSFVASIPVAEYQGRLIQDLQ
AtCslD6    (580) ATVASEPEYYTDEEDRFDIGLIRKQFGSSSMLVNSVKVAEFEGRPLATVH
OsCslF7    (462) ------------SPGGGVAADPAKFGESAPFLASVRAEQSHSR------
OsCslF1    (474) -----AA--------SQIKAMDIANKFGSSTSFVGTMLDGANQER------
OsCslF2    (504) -----AA--------SQIKAMDIANKFGSSTSFVGTMLDGANQER------
OsCslF4    (505) -----AG--------SQIKAMDNANKFGASSTLVSSMLDGANQER------
OsCslF3    (501) -----R---------QDNITPEASKFGNSILLLESVLEALNQDR------
AtCslB1    (341) ---L----SSLATRKYLAEGNLAREFGNSNEMVTSVVEALQR--------
```

Figure 5HH

```
AtCslB2    (384)  ---L----SSIATRKYLAE SLTREFGNSKEMVKSVVDALQR--------
AtCslB4    (384)  ---L----SSVATRELLAE SLSSGFGNSKEMVTSVVEALQR--------
AtCslB3    (385)  ---L----SSVATREFLVK SLARRFGNSKEMMKSVVDAIQR--------
AtCslB5    (384)  ---I----SQVATREFLAE SLVRKYGNSKELVKSVVDALQR--------
AtCslB6    (473)  ---L----SSVASREFLSE SLVRKYGSSKELVKSVVDALQR--------
OsCslH1    (382)  ---------REGTTGYSSNKELHSKFGSSNNFKESARDVIYGNL------
OsCslH2    (394)  ---------REDTIGSSSYKELHTRFGNSEELNESARNIIWD-L------
AtCslE1    (396)  ----------------EEEE EESERIHENLEP-----EM----------
OsCslE1    (391)  ----------------KDYK NWNRGIKERGKENINEIEEK---------
OsCslE5    (284)  ----------------KTTRKT -RGIKEKTQADIYEIEIK---------
AtCslG1    (402)  ----------------LILP INELKPYRIADKSIKAQDVLSL-------
AtCslG2    (390)  ----------------LILP IETFGPNRIADKPIKAQDILAL-------
AtCslG3    (392)  ----------------LILP IDELKPNRIVDKPINAQDVLAL-------
AtCslC12   (421)  ----------------------- DS ----------------------
OsCslC1    (413)  ----------------------- DS ----------------------
OsCslC7    (295)  ----------------------- DS ----------------------
OsCslC9    (318)  ----------------------- DS ----------------------
AtCslC5    (407)  ----------------------- ES ----------------------
AtCslC8    (407)  ----------------------- ES ----------------------
OsCslC3    (441)  ----------------------- DS ----------------------
OsCslC2    (413)  ----------------------- ES ----------------------
AtCslC4    (379)  ----------------------- ES ----------------------
AtCslC6    (401)  ----------------------- DC ----------------------
OsCslA8    (265)  ----------------------- EA ----------------------
OsCslA2    (272)  ---------------------- QS ----------------------
OsCslA4    (292)  ----------------------- EA ----------------------
OsCslA5    (314)  ----------------------- DA ----------------------
OsCslA7    (329)  ----------------------- EA ----------------------
OsCslA3    (355)  ----------------------- EA ----------------------
OsCslA11   (322)  ----------------------- DA ----------------------
OsCslA6    (281)  ----------------------- ES ----------------------
AtCslA1    (152)  ----------------------- AA ----------------------
AtCslA10   (302)  ----------------------- EA ----------------------
AtCslA15   (291)  ----------------------- EA ----------------------
AtCslA11   (193)  ----------------------- EA ----------------------
AtCslA14   (275)  ----------------------- EAE ---------------------
AtCslA3    (300)  ----------------------- EA ----------------------
AtCslA7    (299)  ----------------------- ES ----------------------
AtCslA2    (277)  ----------------------- EA ----------------------
PoXylS     (277)  ----------------------- EA ----------------------
OsCslA1    (264)  ----------------------- EA ----------------------
OsCslA9    (272)  ----------------------- EA ----------------------
AtCslA9    (277)  ----------------------- EA ----------------------
PtCslA1    (275)  ----------------------- EA ----------------------
PtCslA2    (279)  ----------------------- EA ----------------------
CtManS     (271)  ----------------------- DA ----------------------
PpCslA1    (269)  ----------------------- EA ----------------------
Consensus  (1001)                          E G
                  1051                                          1100
AtCesA1    (728)  FIAATFMEQGGIPPTTNPA--TLLKEAIHVIS GY DK EW --------
AtCesA10   (715)  FIAATFMEQGGLPSTTNPL--TLLKEAIHVIS GY AK DW --------
ZmCesA1    (722)  FIASTFMTQGGIPPSTNPA--SLLKEAIHVIS GY DK EW --------
ZmCesA2    (721)  FIASTFMTQGGIPPSTNPA--SLLKEAIHVIS GY DK EW --------
ZmCesA3    (716)  FIASTFMTQGGIPPSTNPG--SLLKEAIHVIS GY DK EW --------
```

Figure 5II

```
AtCesA2   (732) FVASAVLQNGGVPRNASPA--CLLREAIQVISCGYEDKTEWG---------
AtCesA9   (736) LVASTLLLNGGVPSNVNPA--SLLRESIQVISCGYEEKTEWG---------
AtCesA5   (718) FVASAGMENGGLARNASPA--SLLREAIQVISCGYEDKTEWG---------
AtCesA6   (733) FVASARMENGGMARNASPA--CLLKEAIQVISCGYEDKTEWG---------
ZmCesA6   (707) FVASTLLENGGTLKSASPA--SLLKEAIHVISCGYEDKTGWG---------
ZmCesA7   (734) FVTSTLLENGGTLKSASPA--SLLKEAIHVISCGYEDKTDWG---------
ZmCesA8   (742) FVASTLLENGGTLKSASPA--SLLKEAIHVISCGYEDKTDWG---------
AtCesA3   (713) FVASTLMENGGVPPSATPE--NLLKEAIHVISCGYEDKSDWG---------
ZmCesA4   (725) FVASTLMEYGGVPQSATPE--SLLKEAIHVISCGYEDKTEWG---------
ZmCesA9   (727) FVASTLMEYGGVPQSATPE--SLLKEAIHVISCGYEDKIEWG---------
ZmCesA5   (724) FVASTLMEYGGVPQSATPE--SLLKEAIHVISCGYEDKTDWG---------
AtCesA7   (674) FVTSTLMEEGGVPPSSSPA--VLLKEAIHVISCGYEDKTEWG---------
ZmCesA12  (698) FVTSTLMEEGGVPPSSSPA--ALLKEAIHVISCGYEDKTDWG---------
ZmCesA13  (698) FVTSTLMEEGGVPPSSSPA--ALLKEAIHVISCGYEDKTDWG---------
AtCesA4   (663) FIASTLMENGGLPEATNTS--SLIKEAIHVISCGYEEKTEWG---------
ZmCesA10  (723) FIASTLVEDGGLPQGAAADPAALIKEAIHVISCGYEEKTEWG---------
AtCesA8   (631) FIESTLMENGGVPDSVNPS--TLIKEAIHVISCGYEEKTEWG---------
ZmCesA11  (630) FIESTLMENGGVPESANPS--TLIKEAIHVISCGYEEKTEWG---------
AtCslD1   (688) SVK-NGRPPGALLLPRPPLDAPTVAEAIAVISCWYEDNTEWG---------
AtCslD2   (795) AVK-NGRPPGALTIPRELLDASTVAEAIAVISCWYEDKTEWG---------
AtCslD3   (795) AVQ-NGRPPGALTIPRELLDASTVAEAIAVISCWYEDKTEWG---------
OsCslD2   (820) GVK-NGRPPGALTVPRDLLDASTVAEAISVISCWYEDKTEWG--------
OsCslD1   (775) SVK-NGRPPGALTIPRETLDASIVAEAISVVSCWYEEKTEWG---------
AtCslD4   (756) AVK-YGRPPGALRVPRDPLDATTVAESVSVISCWYEDKTEWG---------
OsCslD3   (794) AVL-HGRPSGALTVPRPPLDPPTVAEAVSVISCWYEDKTEWG---------
AtCslD5   (830) GKGKNSRPAGSLAVPREPLDAATVAEAISVISIFYEDKTEWG---------
AtCslD6   (630) SSR-LGRPPGSLTGSRKPLDFATVNEAVNVISCWYEDKTEWG---------
OsCslF7   (493) ------------------DDGDAIAEASALVSCAYEDGTAWG---------
OsCslF1   (506) -----------S-ITPLAVLDESVAGDLAALTACAYEDGTSWG---------
OsCslF2   (536) -----------S-ITPLAVLDESVAGDLAALTACAYEDGTSWG---------
OsCslF4   (537) -----------S-ITPPVAIDGSVARDLAAVTACGYDLGTSWG---------
OsCslF3   (531) -----------F-ATPSPVNDIFVN-ELEMVVSASFDKETDWG---------
AtCslB1   (376) ------------KPNPQNTLANSLEAAQEVGHCHFEYQTSWG---------
AtCslB2   (419) ------------KPFPQKNLKDSLETAQEMGHCHYEYQTSWG---------
AtCslB4   (419) ------------KPNPQNILTNSIEAAQEVGHCDYFSQTSWG---------
AtCslB3   (420) ------------NPNPQNILTNSIEAAREVGHF------------------
AtCslB5   (419) ------------KSNPQKSLANLIEAAQEVGHCHYEYQTSW---------
AtCslB6   (508) ------------KSNPQKSLANLVEAAQEVGHCHYEYQTSW---------
OsCslH1   (417) ------------STEPIVDISSCVDVAKEVAACNYEIGTCWG---------
OsCslH2   (428) ------------SSKPMVDISSRIEVAKAVSACNYDIGTCWG---------
AtCslE1   (415) --------------------IKALASCTY-DENTQWGK---------
OsCslE1   (416) --------------------ATSLVTCTY-EHRTQWGN---------
OsCslE5   (308) --------------------AKSLATCTC-EHRTQWGN---------
AtCslG1   (429) --------------------AHNVAGCIY-EYNTNWGS---------
AtCslG2   (417) --------------------AHDVAGCNY-LCNTNWGS---------
AtCslG3   (419) --------------------AHRVAGCIY-LLNTNWGSKFVIPYN
AtCslC12  (424) ---------------------------------------------------
OsCslC1   (416) ---------------------------------------------------
OsCslC7   (298) ---------------------------------------------------
OsCslC9   (321) ---------------------------------------------------
AtCslC5   (410) ---------------------------------------------------
AtCslC8   (410) ---------------------------------------------------
OsCslC3   (444) ---------------------------------------------------
OsCslC2   (416) ---------------------------------------------------
```

Figure 5JJ

```
  AtCslC4    (382)  --------------------------------------------------
  AtCslC6    (404)  --------------------------------------------------
  OsCslA8    (268)  --------------------------------------------------
  OsCslA2    (275)  --------------------------------------------------
  OsCslA4    (295)  --------------------------------------------------
  OsCslA5    (317)  --------------------------------------------------
  OsCslA7    (332)  --------------------------------------------------
  OsCslA3    (358)  --------------------------------------------------
 OsCslA11    (325)  --------------------------------------------------
  OsCslA6    (284)  --------------------------------------------------
  AtCslA1    (155)  --------------------------------------------------
 AtCslA10    (305)  --------------------------------------------------
 AtCslA15    (294)  --------------------------------------------------
 AtCslA11    (196)  --------------------------------------------------
 AtCslA14    (278)  --------------------------------------------------
  AtCslA3    (303)  --------------------------------------------------
  AtCslA7    (302)  --------------------------------------------------
  AtCslA2    (280)  --------------------------------------------------
   PoXylS    (280)  --------------------------------------------------
  OsCslA1    (267)  --------------------------------------------------
  OsCslA9    (275)  --------------------------------------------------
  AtCslA9    (280)  --------------------------------------------------
  PtCslA1    (278)  --------------------------------------------------
  PtCslA2    (282)  --------------------------------------------------
   CtManS    (274)  --------------------------------------------------
  PpCslA1    (272)  --------------------------------------------------
Consensus   (1051)                              V  C YE  T WG
                   1101            *                            1150
  AtCesA1    (768)  ------KEIGWIYGSVTEDILTGFKMHARGWISIYCNPPRPAFKGSAPI
 AtCesA10    (755)  ------KEIGWIYGSVTEDILTGFKMHARGWISIYCVPSRPAFKGSAPI
  ZmCesA1    (762)  ------KEIGWIYGSVTEDILTGFKMHARGWQSIYCMPPRPCFKGSAPI
  ZmCesA2    (761)  ------KEIGWIYGSVTEDILTGFKMHARGWQSIYCMPPRPCFKGSAPI
  ZmCesA3    (756)  ------KEIGWIYGSVTEDILTGFKMHARGWISIYCMPLRPCFKGSAPI
  AtCesA2    (772)  ------KEIGWIYGSVTEDILTGFKMHCHGWRSVYCMPKRAAFKGSAPI
  AtCesA9    (776)  ------KEIGWIYGSVTEDILTGFKMHCHGWRSVYCMPKRAAFKGSAPI
  AtCesA5    (758)  ------KEIGWIYGSVTEDILTGFKMHSHGWRSVYCTPKIPAFKGSAPI
  AtCesA6    (773)  ------KEIGWIYGSVTEDILTGFKMHSHGWRSVYCTPKLAAFKGSAPI
  ZmCesA6    (747)  ------KDIGWIYGSVTEDILTGFKMHCHGWRSIYCIPKRAAFKGSAPL
  ZmCesA7    (774)  ------KEIGWIYGSVTEDILTGFKMHCHGWRSIYCIPKRVAFKGSAPL
  ZmCesA8    (782)  ------KEIGWIYGSITEDILTGFKMHCHGWRSIYCIPKRPAFKGSAPL
  AtCesA3    (753)  ------MEIGWIYGSVTEDILTGFKMHARGWRSIYCMPKLPAFKGSAPI
  ZmCesA4    (765)  ------TEIGWIYGSVTEDILTGFKMHARGWRSIYCMPKRPAFKGSAPI
  ZmCesA9    (767)  ------TEIGWIYGSVTEDILTGFKMHARGWRSIYCMPKRPAFKGSAPI
  ZmCesA5    (764)  ------TEIGWIYGSVTEDILTGFKMHARGWRSIYCMPKRPAFKGSAPI
  AtCesA7    (714)  ------TELGWIYGSITEDILTGFKMHCRGWRSIYCMPKRPAFKGSAPI
 ZmCesA12    (738)  ------LELGWIYGSITEDILTGFKMHCRGWRSVYCMPKRAAFKGSAPI
 ZmCesA13    (738)  ------LELGWIYGSITEDILTGFKMHCRGWRSVYCMPKRAAFKGSAPI
  AtCesA4    (703)  ------KEIGWIYGSVTEDILTGFRMHCRGWKSVYCMPKRPAFKGSAPI
 ZmCesA10    (765)  ------KEIGWIYGSVTEDILTGFKMHCRGWKSIYCTPTRPAFKGSAPI
  AtCesA8    (671)  ------KEIGWIYGSITEDILTGFKMHCRGWRSIYCMPLRPAFKGSAPI
 ZmCesA11    (670)  ------KEIGWIYGSVTEDILTGFKMHCRGWRSIYCMPVRPAFKGSAPI
  AtCslD1    (729)  ------DRIGWIYGSVTEDVVTGYRMHNRGWRSVYCITKRDAFRGTAPI
  AtCslD2    (836)  ------SRIGWIYGSVTEDVVTGYRMHNRGWKSVYCVTKRDAFRGTAPI
  AtCslD3    (836)  ------SRIGWIYGSVTEDVVTGYRMHNRGWKSVYCVTKRDAFRGTAPI
```

Figure 5KK

```
OsCslD2    (861)  -------QRVGWIYGSVTEDVVTGYRMHNRGWKSVYCVTKRDAFRGTAPI
OsCslD1    (816)  -------TRVGWIYGSVTEDVVTGYRMHNRGWKSVYCVTHRDAFRGTAPI
AtCslD4    (797)  -------DRVGWIYGSVTEDVVTGYRMHNRGWRSVYCITKRDSFRGSAPI
OsCslD3    (835)  -------DRVGWIYGSVTEDVVTGYRMHNRGWRSVYCITKRDAFLGTAPI
AtCslD5    (872)  -------KRVGWIYGSVTEDVVTGYRMHNRGWRSIYCVTKRDAFRGTAPI
AtCslD6    (671)  -------FNVGWIYGSVTEDVVTGFRMHEKGWRSFYCVTEPDAFRGSAPI
OsCslF7    (517)  -------RDVGWVYGTVTEDVATGFCMHRRGWRSAYYAAAPDAFRGTAPI
OsCslF1    (537)  -------RDVGWVYNIATEDVVTGFRMHRQGWRSVYASVEPAAFRGTAPI
OsCslF2    (567)  -------RDVGWVYNIATEDVVTGFRMHRQGWRSVYASVEPAAFRGTAPI
OsCslF4    (568)  -------RDAGWVYDIATEDVATGFRMHQQGWRSVYTSMEPAAFRGTAPI
OsCslF3    (561)  -------KGVGYIYDIATEDIVTGFRIHGQGWRSMYCTMEHDAFCGTAPI
AtCslB1    (406)  -------KTIGWLYESTAEDANTSIGIHSRGWTSSYISPKPPAFLGAMPP
AtCslB2    (449)  -------KNIGWLIDSTTEDVNTSIGIHSRGWTSSYIFPDPPAFLGCMPQ
AtCslB4    (449)  -------KTIGWLYDSMSEDMNTSIGIHSRGWTSSYIAPDPPAFLGSMPP
AtCslB3    (441)  -------MQIGWLYDSVAEDLNTSIGIHSRGWTSSYISPDTPAFLGSMPA
AtCslB5    (448)  -------GNLGWMYDSVAEDTNTSVGIHLRGWTSSFISPDPPAFIGSTPT
AtCslB6    (537)  -------GNLGWLYDSVAEDTNTSIGIHLRGWTSSFTSPDPPAFLGSTPS
OsCslH1    (447)  -------QEVGWVYGSITEDVLTGQRIHAAGWRSTLMEIEPPAFMGCAPN
OsCslH2    (458)  -------QEVGWVYGSLTEDILTGQRIHAMGWRSVLMVTEPPAFMGSAPI
AtCslE1    (432)  --------EMGVKYGCPVEDVITGLTIQCRGWKSAYLNPEKQAFLGVAPT
OsCslE1    (433)  --------DIGVKYGFPAEDIITGLAIHCRGWESAFINPKRAAFLGLAPS
OsCslE5    (325)  --------EIEIKYGCTVEDIFIELAINCRGWESVYINPQRAALLGVGPA
AtCslG1    (446)  --------KIGERYGSLVEDYYTGFMLACEGWRSVECNPKKAAFYGDSPK
AtCslG2    (434)  --------KIGERYGSLVEDYFTGFMDHCEGWRSIECSPTKAAFYGDSPK
AtCslG3    (443)  FILSFKTMQIGERYGSLVEDYYTGYRLHCEGWRSVFCRPKRAAFCGDSPK
AtCslC12   (424)  --------------GWLERTTVEDMDIAVRAHLHGWKFVFLN--DVECQCELPE
OsCslC1    (416)  --------------GWMERTTVEDMDIAVRAHLKGWKFLYIN--DVECQCELPE
OsCslC7    (298)  --------------GWMERTTVEDMDIAVRAHLKGWKFVFLN--DVECQCELPE
OsCslC9    (321)  --------------GWMERTTVEDMDIAVRAHLRGWKFIFLN--DVECQCELPE
AtCslC5    (410)  --------------GWIERTTVEDMDIAVRAHLHGWKFIYLN--DVKVLCEVPE
AtCslC8    (410)  --------------GWIERTTVEDMDIAVRAHLHGWKFIYLN--DVKVLCEVPE
OsCslC3    (444)  --------------GWMERTTVEDMDIAVRAHLNGWKFTFLN--DVKVLCELPE
OsCslC2    (416)  --------------GWLERTTVEDMDIAVRAHLNGWKFTFLN--DVKVLCELPE
AtCslC4    (382)  --------------GWIERTTVEDMDIAVRAHLNGWKFTYLN--DVEVTCELPE
AtCslC6    (404)  --------------GWIERTTVEDMDIAVRAHLCGWKFIYLN--DVKCLCELPE
OsCslA8    (268)  --------------GWKERTTVEDMDLAVRASLRGWRFVYVG--HVGVRNELPS
OsCslA2    (275)  --------------GWKDRTTVEDMDLAVRASLKGWEFLVVG--DIRVKSELPS
OsCslA4    (295)  --------------GWKDRTTVEDMDLAVRASLKGWQFLYVG--DIRVKSELPS
OsCslA5    (317)  --------------GWKDRTTVEDMDLAVRATLKGWKFIYLG--DLRVKSELPS
OsCslA7    (332)  --------------GWKDRTTVEDMDLAVRASLNGWKFLYVG--DIRVKSELPS
OsCslA3    (358)  --------------GWKDRTTVEDMDLAVRAGLKGWKFVYLA--DVKVKSELPS
OsCslA11   (325)  --------------GWKDRTTVEDMDLAVRATLQGWKFVYVG--DVKVKSELPS
OsCslA6    (284)  --------------GWEDRTTAEDMDLALRAGLLGWEFVYVG--SIKVKSELPS
AtCslA1    (155)  --------------GWKSRTTVEDMDLAVRVGLHGWKFVYLN--DLTVRNELPS
AtCslA10   (305)  --------------GWHDRTTVEDMDLAVRAGLLGWKFVFLN--DLTVKSELPS
AtCslA15   (294)  --------------GWKDRTTVEDMDLAVRVGLLGWKFIFVN--DLEVKSELPS
AtCslA11   (196)  --------------GWKDRTTVEDMDLAVRVGLHGWKFVFVN--DVSVKSELPS
AtCslA14   (278)  --------------GWKDRTIVEDMDLAVRAYLRGSKFVYVD--DVKVKNELPS
AtCslA3    (303)  --------------GWKDRTTVEDMDLAVRACLHGWKFVYVH--DVEVKNELPS
AtCslA7    (302)  --------------GWNDQTTVEDMDLAVRATLRGWKFLYID--DLKVKSELPC
AtCslA2    (280)  --------------GWKDRTTVEDMDLAVRASLRGWKFLYLG--DLQVKSELPS
PoXylS     (280)  --------------GWKDRTTVEDMDLAVRAGLKGWKFLYLG--DLHVKSELPS
OsCslA1    (267)  --------------GWKDRTTVEDMDLAIRASLKGWKFVYLG--DVQVKSELPS
OsCslA9    (275)  --------------GWKDRTTVEDMDLAVRAGLKGWKFVYLG--DLMVKSELPS
```

Figure 5LL

```
AtCslA9    (280) ----------GWKDRTTVEDMDLAVRASLKGWKFLYLG--SLKVKNELPS
PtCslA1    (278) ----------GWKDRTTVEDMDLAVRASLKGWKFVFVG--DLKVKNELPS
PtCslA2    (282) ----------GWKDRTTVEDMDLAVRASLRGWKFVFVG--DLGVKNELPS
CtManS     (274) ----------GWKDRTTVEDMDLAVRASLHGWEFVFVG--DVKVKNELPS
PpCslA1    (272) ----------GWNDRTTVEDMDLAVRASLCGWKFVYIH--DLEVKNELPS
Consensus (1101)           IGWIY SV EDM TGVRMH RGWKSVYL    AFKG AP
                 1151      *  ** #  #                            1200
AtCesA1    (811) NLSDRLN-QVLRWALGSIEILLSRHCPIWYGYH--GRLRLLERIAYINTI
AtCesA10   (798) NLSDRLN-QVLRWALGSIEILLSRHCPIWYGYN--GRLKLLERIAYINTI
ZmCesA1    (805) NLSDRLN-QVLRWALGSVEILLSRHCPIWYGYN--GRLKLLERLAYINTI
ZmCesA2    (804) NLSDRLN-QVLRWALGSVEILLSRHCPIWYGYN--GRLKLLERLAYINTI
ZmCesA3    (799) NLSDRLN-QVLRWALGSVEILLSRHCPIWYGYN--GRLKLLERLAYINTI
AtCesA2    (815) NLSDRLH-QVLRWALGSVEIFLSRHCPIWYGYG--GGLKWLERFSYINSV
AtCesA9    (819) NLSDRLH-QVLRWALGSVEIFLSRHCPIWYGYG--GGLKWLERFSYINSV
AtCesA5    (801) NLSDRLH-QVLRWALGSVEIFLSRHCPIWYGYG--GGLKWLERLSYINSV
AtCesA6    (816) NLSDRLH-QVLRWALGSVEIFLSRHCPIWYGYG--GGLKWLERLSYINSV
ZmCesA6    (790) NLSDRFH-QVLRWALGSIEILFSNHCPLWYGYG--GGLKFLERFSYINSI
ZmCesA7    (817) NLSDRLH-QVLRWALGSIEIFFSNHCPLWYGYG--GGLKFLERFSYINSI
ZmCesA8    (825) NLSDRLH-QVLRWALGSVEIFSKHCPLWYGYG--GGLKFLERFSYINSI
AtCesA3    (796) NLSDRLN-QVLRWALGSVEILFSRHCPIWYGYN--GRLKFLERFAYVNTT
ZmCesA4    (808) NLSDRLN-QVLRWALGSVEILFSRHCPIWYGYG--GRLKFLERFAYINTT
ZmCesA9    (810) NLSDRLN-QVLRWALGSVEILFSRHCPIWYGYG--GRLKFLERFAYINTT
ZmCesA5    (807) NLSDRLN-QVLRWALGSVEILFSRHCPIWYGYG--GRLKFLERFAYINTT
AtCesA7    (757) NLSDRLN-QVLRWALGSVEIFFSRHSPLWYGYK-GGKLKWLERFAYANTT
ZmCesA12   (781) NLSDRLN-QVLRWALGSVEIFFSRHSPLIYGYK-NGNLKWLERFAYINTT
ZmCesA13   (781) NLSDRLN-QVLRWALGSVEIFFSRHSPLIYGYK-NGNLKWLERFAYINTT
AtCesA4    (746) NLSDRLH-QVLRWALGSVEIFFSRHCPLWYAWG--GKLKILERLAYINTI
ZmCesA10   (808) NLSDRLH-QVLRWALGSVEIFMSRHCPIRYAYG--GRLKWLERFAYTNTI
AtCesA8    (714) NLSDRLH-QVLRWALGSVEIFLSRHCPLWYGCS-GGRLKLLQRLAYINTI
ZmCesA11   (713) NLSDRLH-QVLRWALVSVEIFFSRHCPLWYGYG-GGRLKWLQRLSYINTI
AtCslD1    (772) NLTDRLH-QVLRWATGSVEIFFSKNNAMFAT----RRLKFLQRVAYINVG
AtCslD2    (879) NLTDRLH-QVLRWATGSVEIFFSRNNALLAS----SKMKILQRIAYINVG
AtCslD3    (879) NLTDRLH-QVLRWATGSVEIFFSRNNAFFAS----PRMKILQRIAYINVG
OsCslD2    (904) NLTDRLH-QVLRWATGSVEIFFSRNNALLAS----RKMKFLQRIAYINVG
OsCslD1    (859) NLTDRLH-QVLRWATGSVEIFFSRNNALFAS----SKMKVLQRIAYINVG
AtCslD4    (840) NLTDRLH-QVLRWATGSVEIFFSRNNAILAS----KRLKFLQRIAYINVG
OsCslD3    (878) NLTDRLHHQVLRWATGSVEIFFSRNNAFLAS----RKMLLQRISYINVG
AtCslD5    (915) NLTDRLH-QVLRWATGSVEIFFSRNNAIFAT----RRLKFLQRVAYFNVG
AtCslD6    (714) NLTDRLH-QVLRWATGSVEIFFSRNNAIFAG----PKLKLLQRIAYINVG
OsCslF7    (560) NLADRLH-QVLRWAAGSLEIFFSRNNALLAGGR--RRLHPLQRAAYINTT
OsCslF1    (580) NLTERLY-QILRWSGGSLEMFFSHSNALLAG----RRLHPLQRVAYINMS
OsCslF2    (610) NLTERLY-QILRWSGGSLEMFFSHSNALLAG----RRLHPLQRVAYINMS
OsCslF4    (611) NLTERLY-QILRWSGGSLEMFFSHSNALLAG----RRLHPLQRIAYINMS
OsCslF3    (604) NLTERLH-QIVRWSGGSLEMFFSHNNPLIGG----RRLQPLQRVSYINMT
AtCslB1    (449) GGPEAML-QQRRWATGLLEVLFNKQSPLIGMFCR--KIRFRQSLAYLYIF
AtCslB2    (492) GGPEVMV-QQRRWATGLLEILFNKQSPLIGMFCR--KIRFRQSLAYLYVF
AtCslB4    (492) GGLEAMI-QQRRWATGSIEVLFNKQSPLLGLFCR--KLRFRQRVAYLCVS
AtCslB3    (484) GVPEALL-QQRRWATGWIEILFNKQSPLRGLFSK--KIRFRQRLAYLCII
AtCslB5    (491) LGLEAIV-QQRRWATGAIEVLFNKQSPFMGMFHG--KIKFRQRLAYFWAL
AtCslB6    (580) VGPEAIV-QHRRWATGSIEVLFNKQSPLIGFRR---KIKFRQRLAYFWVL
OsCslH1    (490) GGPACLT-QLKRWASGFLEILISRNNPIITTFK--SLQFRQCLAYLHSY
OsCslH2    (501) GGPACLT-QFKRWATGQSEIIISRNNPIIATMFK--RLKFRQCLAYLIVL
AtCslE1    (474) NLHQMIV-QQRRWSEGDFQIMLSKYSPVWYGKG---KISLGLILGYCCYC
OsCslE1    (475) TLAQNIL-QHKRWSENITIFLSKYCSFLFGHG---KIKLQLQMGYCICG
```

Figure 5MM

```
OsCslE5    (367) T AQT L-QRKRWGEDN T  FSKNCPF IGHG---K KLQLQMG CLFG
AtCslG1    (488) C V LVG-Q IRWAV LF MSF KYSP TYGIK---S DL MGLG CNSP
AtCslG2    (476) C TDV G-Q IRWSV LLEVAFSRYNPLTYGIK---PLSL MSLG CHYA
AtCslG3    (493) S ID V S-Q KRWA G LEVAI SRYSP TYGVK---SMGLVTGVG CQYA
AtCslC12   (462) SYEAYRK-Q HRWHSGPMQL  RLCLPAV KSK------IS GKKFN  IFL
OsCslC1    (454) SYEAYRK-Q HRWHSGPMQL  RLCFVD I KSK------IGVWKKFN IFL
OsCslC7    (336) SYEAYRK-Q HRWHSGPMQL  RLCFVD I KS-------IGFWKKFN IFL
OsCslC9    (359) SYEAYRK-Q HRWHSGPMQL  RLCLPD I KCK------IVFWKKAN IFL
AtCslC5    (448) SYEAYKK-Q HRWHSGPMQL  RLCLGS I TSK------IA WKKAN ILL
AtCslC8    (448) SYEAYKK-Q HRWHSGPMQL  RLCLRS I TSK------IAMWKKAN ILL
OsCslC3    (482) SYQAYRK-Q HRWHSGPMQL  RLCLPAVFKSK------ISTWKKAN VML
OsCslC2    (454) SYEAYRK-Q HRWHSGPMHL WLCLPD I TAK------ISSWKKAN ILL
AtCslC4    (420) SYEAYKK-Q HRWHSGPMQL  RLCLPS I KSK------IS WKKAN IFL
AtCslC6    (442) SYEAYKK-Q QYRWHSGPMQL  RLCFFD I RSK------VSAAKKAN IFL
OsCslA8    (306) T RAYRY-Q HRWSC PANL RKIFLEAPPPAC-----PPGRSSTSSTIS
OsCslA2    (313) TFQAYRH-Q HRWTCGAANL RKMAWE TNKE-----VSMWRKY  LYS
OsCslA4    (333) TFKAYRH-Q HRWTCGAANL RKMATE AKNKG-----VSV WKKL  LYS
OsCslA5    (355) TYKAYCR-Q FRWSC GANL RKMIWD V VAKK-----VSSLKKI  LYS
OsCslA7    (370) TYGAYCR-Q FRWAC GANL RKIAMD V VAKD-----IS  LKKF MLYS
OsCslA3    (396) N KTYRH-Q HRWTCGAANL RKVGAE LFTKE-----VPFWWKF  LYS
OsCslA11   (363) TFKAYRF-Q HRWSC PANL KKMVE LENKK-----VSFWNKIH WYD
OsCslA6    (322) T KAYRS-Q HRWSC PALL KKMFWE LAAKK-----VSFWKKL MTYD
AtCslA1    (193) KFKAYRF-Q HRWSC PANL RKMTME I FNKR-----VS WKKF V IYS
AtCslA10   (343) KFKAFRF-Q HRWSC PANL RKMIME I RNKR-----VT WKKL I VYS
AtCslA15   (332) QFKAFRF-Q HRWSC PANL IRKMTME I HNKR-----VK WKKF V IYS
AtCslA11   (234) QFKAFRF-Q HRWSC PANL RKMTME I RNKR-----VT WKKL V IYS
AtCslA14   (316) SFQAYRF-Q HRWSC PANL KKIAME I KNQN-----VSL WKKV I IYN
AtCslA3    (341) TFKAYRF-Q HRWSC PANL WRKMTME I QNKK-----VSAWKKL I IYN
AtCslA7    (340) SFKALRS-Q HRWTCC PANL LRKMAGQ I RSEN-----VS WKKW YMLYS
AtCslA2    (318) TFRAFRF-Q HRWSC PANL RKMVME IVRNKK-----VRFWKKV V IYS
PoXylS     (318) TFKAFRF-Q HRWSC PANL RKMVFD ATNKK-----VT YKKF V IYS
OsCslA1    (305) TFKAFRF-Q HRWSC PANL RKMLME IVRNKK-----VT WKKIH V IYN
OsCslA9    (313) TFKAFRY-Q HRWSC PANL RKMLVE ATNKK-----VT WKKI V IYN
AtCslA9    (318) TFKAYRY-Q HRWSC PANL RKMAFE IMTNKN-----VT WKKVH V IYS
PtCslA1    (316) TFKAYRY-Q HRWSC PANL RKMVME I RNKR-----VTPWKKF H V IYA
PtCslA2    (320) TFKAYRY-Q HRWSC PANL RKMVRE I ANKK-----VSAWKKF H V IYG
CtManS     (312) TFKAYRF-Q HRWSC PANL KKMTKE I CCKR-----VP LKRLH IYA
PpCslA1    (310) TFKAFRF-Q HRWSC PANL RKVLFT ILKNQN-----LR WKRLH MIYA
Consensus (1151)      L D L   QQ RWA GSVEIF SR     IL           L   L R AYL
                                                                   1201                                                      1250
AtCesA1    (858) V PIT S PL A CIL AFC ITD-R IPEISNYAS WF LLF S--IAV
AtCesA10   (845) V PIT S PL A CM  AFC ITN-T IPEISNLAS CFMLLFAS--IYA
ZmCesA1    (852) V PIT S PL A CV  PAIC ITN-K IPEISNYAGMFF LLFAS--IFA
ZmCesA2    (851) V PIT SVPL A CV  PAIC ITN-K IPEISNYAGMFF LLFAS--IFA
ZmCesA3    (846) V P TS PLVA CV  PAIC ITN-K IPAISNYAGFF LLFAS--IFA
AtCesA2    (862) V PWT S PL IV CS PAVC ITG-K IVPEISNYAG IL FMLFIS--IAV
AtCesA9    (866) V PWT S PL IV CS PAIC ITG-K IVPEISNYAG IL FLLMFMS--IAV
AtCesA5    (848) V PWT S PL IV CS PAIC ITG-K IVPEISNYAS ILFMALFGS--IAV
AtCesA6    (863) V PWT S PL IV CS PAIC ITG-K IVPEISNYAS ILFMALFSS--IAI
ZmCesA6    (837) V PWT S PL A CT PAIC ITG-K ITPELNNVAS WFMSLFIC--IFA
ZmCesA7    (864) V PWT S PL A CT PAIC ITG-K ITPELNNVAS WFMS FIC--IFA
ZmCesA8    (872) V PWT S PL A CT PAIC ITG-K ITPELTNVAS WFMALFIC--ISV
AtCesA3    (843) I P TS PLIMY CT LAVC FTN-Q IPQISNIAS WFLS FLS--IFA
ZmCesA4    (855) I PLTS PL II CIL AIC ITG-K IPEISNFAS WF S FIS--IFA
```

Figure 5NN

```
ZmCesA9   (857) IYPLTSLPLLIYCILPAICLLTG-KFIIPEISNFASIWFISLFIS--IFA
ZmCesA5   (854) IYPLTSIPLLLYCILPAVCLLTG-KFIIPKISNLESVWFISLFIS--IFA
AtCesA7   (805) IYPFTSIPLLAYCILPAICLLTD-KFIMPPISTFASLFFISLFMS--IIV
ZmCesA12  (829) IKPFTSLPLLAYCTLPAVCLLTG-KFIMPSISTFASLFFIALFMS--IFA
ZmCesA13  (829) IYPFTSLPLLAYCTLPAVCLLTG-KFIMPSISTFASLFFIALFMS--IFA
AtCesA4   (793) VYPFTSIPLLAYCTIPAVCLLTG-KFIIPTINNFASIWFLALFLS--IIA
ZmCesA10  (855) VYPFTSIPLLAYCTIPAVCLLTG-KFIIPTLNNLASIWFIALFLS--IIA
AtCesA8   (762) VYPFTSLPLVAYCTLPAICLLTG-KFIIPTLSNLASMLFLGLFIS--IIL
ZmCesA11  (761) VYPFTSLPLVAYCCLPAICLLTG-KFIIPTLSNAATIWFLGLFMS--IIV
AtCslD1   (817) IKPFTSLFLVVYCFLPALCLFSG-KFIVQSLDIHFLSYLLCITVT--LTL
AtCslD2   (924) IYPFTSLFLIVYCFLPALSLFSG-QFIVQTLNVTFLVYLLIISIT--LCL
AtCslD3   (924) IYPFTSFFLIVYCFLPALSLFSG-QFIVQTLNVTFLVYLLIISIT--LCL
OsCslD2   (949) IYPFTSLFLIVYCFLPALSLFSG-QFIVRTLNVTFLTYLLVITLT--MCM
OsCslD1   (904) IYPFTSVFLIVYCFLPALSLFSG-QFIVQTLNVTFLTYLLIITIT--LCL
AtCslD4   (885) IYPFTSLFLILYCFLPAFSLFSG-QFIVRTLSISFLVYLLMITIC--LIG
OsCslD3   (924) IYPFTSIFLLVYCFIPALSLFSG-FFIVQKLDIAFLCYLLTMTIT--LVA
AtCslD5   (960) MYPFTSLFLIVYCILPAISLFSG-QFIVQSLDITFLIYLLSITLT--LCM
AtCslD6   (759) IYPFTSIFILTYCFLPPLSLFSG-HFVVETLTGSFLIYLLIITLS--LCG
OsCslF7   (607) VYPFTSIFLMAYCLFPAIPLIAGGGGWNAAPTPTYVAFLAALMVT--LAA
OsCslF1   (625) TYPIVTVFIFFYNLFPVMWLISE-QYYIQRPFGEYLLYLVAVIAM--IHV
OsCslF2   (655) TYPIVTVFIFFYNLFPVMWLISE-QYYIQRPFGEYLLYLVAVIAM--IHV
OsCslF4   (656) TYPIVTVFIFFYNLFPVMWLISE-QYYIQQPFGEYLLYLVAIIAM--IHV
OsCslF3   (649) IYPVTSLFILLAISPVMWLIPD-EVYIQRPFTRIVWYLIVTIILM--IHM
AtCslB1   (496) TWGLRSIPELIYCLLPAYCLLHN-AALFPKG--VYLGIVVTLVGM--HCL
AtCslB2   (539) SWGLRSIPELFYCLLPAYCLLHN-SALFPKG--VYLGIIITLVGI--HCL
AtCslB4   (539) IC-VRSIPELIYCLLPAYCLLHN-SALFPKG--LCLGITMLLAGM--HCL
AtCslB3   (531) TC-LRSIPELIYCLLPAYCLLHN-STLFPKG--LYLGITVTLVGI--HCL
AtCslB5   (538) MC-LRSIPELIYCLLPAYCLLHD-SALFPKG--PCLCTIVTLVGM--HCL
AtCslB6   (626) MC-LRSIPELVYCLLPAYCLLNN-SALFPKG--PCLGIIVTLVGM--HCL
OsCslH1   (537) VWPVRAPFELCYALLGPYCLISN-QSFLPKTSEDGFYIALALFIA--YNT
OsCslH2   (548) GNPLRAPFELCYGLLGPYCLITN-QSFLPKASEDGFSVPLALFIS--YNT
AtCslE1   (520) LWAPSSLPVLIYSVLTSLCLFKGIPLFPKVSSSWFIPFGYVTVA---ATA
OsCslE1   (521) LWAANSLPTLYYVVIPSLGLVKGTPLFPQIMSPWATPFIYVFCV---KTI
OsCslE5   (413) LWASNSLPTLYYVMFPSLG-VKGTPLFPEIMSPWATPFVYVLCFNCEEYI
AtCslG1   (534) FKPFWSIPLTVVGLLPQLALISGVSVFPKASDPWFWLYILLFFG---AYA
AtCslG2   (522) FWPFWCIPLVVYGILPQVALIHGVSVFPKASDPWFWLYILLFLG---GYA
AtCslG3   (539) CWAFWSLPLIVYGFLPQLALLYQSSVFPKSSDPWFWLYIVLFLG---AYG
AtCslC12  (505) FFLLRKLILPFYSFTLFCILLPMTMFVPEAELPAWVVCYIPATMS----F
OsCslC1   (497) FFLLRKLILPFYSFTLFCILLPMTMFVPEAELPAWVVCYIPATMS----L
OsCslC7   (378) FFLLRKLILPFYSFTLFCVLLPMTMFVPEAELPAWVVCYIPATMS----L
OsCslC9   (402) FFLLRKLILPFYSFTLFCILLPMTMFVPEAELPDWVVCYIPALMS----L
AtCslC5   (491) FFLLRKLILPFYSFTLFCILLPLTMFVPEAELPVWVICYIPVFMS----F
AtCslC8   (491) FFLLRKLILPFYSFTLFCVLLPITMFVPEAELPIWVICYVPIFMS----I
OsCslC3   (525) FFLLRKLILPFYSFTLFCVLLPLTMFVPEAELPIWVICYVPVIMS----V
OsCslC2   (497) FFLLRKLILPFYSFTLFCVLLPLTMFVPEAELPVWVICYVPVCMS----F
AtCslC4   (463) FFLLRKLILPFYSFTLFCILLPLTMFIPEAELPLWIICYVPIFIS----I
AtCslC6   (485) FFLLRKLILPFYSFTLFCVLLPLTMFFPEANLPSWVVCYIPGIMS----I
OsCslA8   (350) SSSASSSPTSSPSPSTASSSPPASSPAPTTSASPSTSPSTSPPPS----P
OsCslA2   (357) FFFVRRAIAPILTFLFYCIVIPLSAMVPEVTIPVWGLVYIPTAIT----I
OsCslA4   (377) FFFVRRVVAPILTFLFYCVVIPLSVMVPEVSIPVWGMVYIPTAIT----I
OsCslA5   (399) FFLVRRVVAPAVAFLLYNVIIPVSVMFPELFLPIWGVAYIPTALL----I
OsCslA7   (414) FFLVRRVVAPMVACVLYNILVPLSVMFPELFIPIWGVAYIPMALL----I
OsCslA3   (440) FFFVRKVVAHVVPFVLYCVVIPFSVLLPEVTVPVWGVVYVPTTIT----I
OsCslA11  (407) FFFVGKLAAHTVTFLYYCFVIPVSVWLPEIEIPLWGVVYVPTVIT----I
```

Figure 5OO

```
OsCslA6     (366)  FFIARRIISTFFTFFFFSVLLPMKVFFPEVQIPLWELILLPTAII----L
AtCslA1     (237)  FFFVRKVAVHFLTFFFYCILVPTSVFFPEIHIPSWSTIYVPSLIS----I
AtCslA10    (387)  FFFLRKIIVHCFTFLFYCVILPTSVFFPEVNIPAWSTFYIPSMIT----L
AtCslA15    (376)  FFFLRKIVHFFTYFFYCVILPTSVFIPEVNIPNWSTIYVPSVIT----L
AtCslA11    (278)  FFFVRKIIVHFFTFFFYCFILPTSVFFPEVNIPTWSTVVFPFMIT----L
AtCslA14    (360)  FFFLRKIVVHIFTFVFYCVILPATVIFPEIEVPKWTTIYIPATIT----I
AtCslA3     (385)  FFFLRKIVVHIFTFVFYCLILPTTVLFPELQVPKWATVVFPTTIT----I
AtCslA7     (384)  FFFMRKIVAHILTFCFYCVILPATVLFPEVTVPKWAAFYLPSLIT----L
AtCslA2     (362)  FFFVRKIIAHWVTFCFYCVVLPLTILMPEVKVPIWGSVYIPSIIT----L
PoXylS      (362)  FFFVRKIIAHMFTFFFYCVVLPLTCLVPEVEVPKWGAIYLPCIIT----V
OsCslA1     (349)  FFLLRKIIAHIVTFAFYCLILPATIFVPEVRIPKWGCVYIPTIIT----I
OsCslA9     (357)  FFLVRKIIGHIVTFVFYCLVPATVLIPEVEIPRWGYVYLPSIVT----I
AtCslA9     (362)  FFVVRKLVAHIVTFLFYCVILPATVLVPEVTVPKWGAVYIPSVIT----I
PtCslA1     (360)  FFFVRKIVAHIVTFTFYCVVLPATVLVPEVQVPKWGAVYIPSIIT----L
PtCslA2     (364)  FFFVRKIVAHIVTFVFYCVVIPTTVLVPEVQLPKWGAVYIPSTIT----L
CtManS      (356)  FFFVRKIVAHWVTFFFYCIVIPACVIVPEVNLKKQIAIYIPATIT----I
PpCslA1     (354)  FFFVRKIVAHIVTFTFYCVVLPASVLVPEVDLPFWGAVYVPSIIT----L
Consensus   (1201) Y  L SI LL Y   LP  LL      FI       W I YI L IS    L
                   1251                                              1300
AtCesA1     (905)  TGILELRWSGVSLEDWRNEQFWVIGGTSAHLFAVFQGLLKVLAGIDTNF
AtCesA10    (892)  SAILELKWSDVALEDWRNEQFWVIGGTSAHLFAVFQGLLKVFAGIDTNF
ZmCesA1     (899)  TGILELRWSGVGLEDWRNEQFWVIGGTSAHLFAVFQGLLKVLAGIDTNF
ZmCesA2     (898)  TGILELRWSGVGLEDWRNEQFWVIGGTSAHLFAVFQGLLKVLAGIDTNF
ZmCesA3     (893)  TGILELRWSGVGLEDWRNEQFWVIGGTSAHLFAVFQGLLKVLAGIDTNF
AtCesA2     (909)  TGILEMQWGGVGIDDWRNEQFWVIGGASSHLFALFQGLLKVLAGVNTNF
AtCesA9     (913)  TGILEMQWGKIGIDDWRNEQFWVIGGVSSHLFALFQGLLKVLAGVSTNF
AtCesA5     (895)  TGILEMQWGKVGIDDWRNEQFWVIGGVSAHLFALFQGLLKVLAGVETNF
AtCesA6     (910)  TGILEMQWGKVGIDDWRNEQFWVIGGVSAHLFALFQGLLKVLAGVDTNF
ZmCesA6     (884)  TSILEMRWSGVGIDDWRNEQFWVIGGVSSHLFAVFQGLLKVIAGVDTSF
ZmCesA7     (911)  TSILEMRWSGVGIDDWRNEQFWVIGGVSSHLFAVFQGLLKVIAGVDTSF
ZmCesA8     (919)  TGILEMRWSGVAIDDWRNEQFWVIGGVSAHLFAVFQGLLKVFAGIDTSF
AtCesA3     (890)  TGILEMRWSGVGIDEWWRNEQFWVIGGVSAHLFAVFQGILKVLAGIDTNF
ZmCesA4     (902)  TGILEMRWSGVGIDEWWRNEQFWVIGGISAHLFAVFQGLLKVLAGIDTNF
ZmCesA9     (904)  TGILEMRWSGVGIDEWWRNEQFWVIGGISAHLFAVFQGLLKVLAGIDTNF
ZmCesA5     (901)  TGILEMRWSGVGIDEWWRNEQFWVIGGISAHLFAVFQGLLKVLAGIDTSF
AtCesA7     (852)  TGILELRWSGVSIEEWWRNEQFWVIGGISAHLFAVQGLLKILAGIDTNF
ZmCesA12    (876)  TGILEMRWSGVSIEEWWRNEQFWVIGGVSAHLFAVQGLLKVLAGIDTNF
ZmCesA13    (876)  TGILEMRWSGVSIEEWWRNEQFWVIGGVSAHLFAVQGLLKVLAGIDTNF
AtCesA4     (840)  TAILELRWSGVSINDLWRNEQFWVIGGVSAHLFAVFQGLLKVLFGVDTNF
ZmCesA10    (902)  TSVLELRWSGVSIEDWRNEQFWVIGGVSAHLFAVFQGFLKVLGGVDTSF
AtCesA8     (809)  TSVLELRWSGVSIEDLWRNEQFWVIGGVSAHLFAVFQGFLKMLAGLDTNF
ZmCesA11    (808)  TSVLELRWSGIGIEDWRNEQFWVIGGVSAHLFAVFQGILKMIAGLDTNF
AtCslD1     (864)  ISLLEVKWSGIGLEEWWRNEQFWLIGGTSAHLAAVVQGLLKVIAGIEISF
AtCslD2     (971)  LALLEIKWSGISLEEWWRNEQFWLIGGTSAHLAAVLQGLLKVVAGVEISF
AtCslD3     (971)  LALLEVKWSGISLEEWWRNEQFWLIGGTSAHLAAVIQGLLKVVAGVEISF
OsCslD2     (996)  LAVLEIKWSGISLEEWWRNEQFWLIGGTSAHLAAVLQGLLKVIAGIEISF
OsCslD1     (951)  LAMLEIKWSGIALEEWWRNEQFWLIGGTSAHLAAVLQGLLKVIAGIEISF
AtCslD4     (932)  LAVLEVKWSGIGLEEWWRNEQWWLIGTSSHLYAVVQGVLKVIAGIEISF
OsCslD3     (971)  LGILEVKWSGIELEDWWRNEQFWLIGTSAHLYAVVQGLLKVMAGIEISF
AtCslD5     (1007) LSLLEIKWSGITHEWWRNEQFWVIGGTSAHPAAVLQGLLKVIAGVDISF
AtCslD6     (806)  LAVLEVKWSGISLEEWWRNEQFWLIGGTSAHLVAVLQGILKVIAGVEISF
OsCslF7     (655)  VAVLETRWSGIALGEWWRNEQFWMVSATSAYLAAVAQVALKVATGKEISF
OsCslF1     (672)  IGMFEVKWAGITLLDWCRNEQFYMIGSTGVYPTAVLYMALKLVTGKGIYF
OsCslF2     (702)  IGMFEVKWAGITLLDWCRNEQFYMIGSTGVYPTAVLYMALKLVTGKGIYF
```

Figure 5PP

```
OsCslF4    (703)  IGMEFVKWSGITVLDWCRNEQFYMIGSTGVYPTAVLYMALKLFTGKGIHF
OsCslF3    (696)  IGWLEIKWAGITWLDYWRNEQFFMLGSTSAYPTAVLHMVVNLLTKKGIHF
AtCslB1    (541)  YSLWEFMSLGFSVQSWFASQSFWRLKTTCSWLFSIPDIILKLLGISKTVF
AtCslB2    (584)  YTLWEFMNLGFSIQSWYVTQSFGRLKTTCSWLFSVLDVILKLLGISKTVF
AtCslB4    (583)  YTLWEFMCLGHSIQSWYVSQSFWRLVATSSWLFSIFDIILKLLGLSKNVF
AtCslB3    (575)  YTLWEFMSLGYSVQSWLVSQSVWRLVATSSWLFSIFDITLKLLGISETVF
AtCslB5    (582)  YSLWQFMSLGFSVQSWYVVQSLWRIIATSSWLFSIQDIILKLLGISQIGF
AtCslB6    (670)  YTLWQFMILGFSVK--------------SCWLFSIQDIILKLLGISKIGF
OsCslH1    (584)  YMFMEFIECGQSARACWNNHRMQRLTSASAWLLAFLTVILKTLGFSETVF
OsCslH2    (595)  YNFMEYMACGLSARAWWNNHRMQRLISVSAWTLAFLTVLLKSLGLSETVF
AtCslE1    (567)  YSLAEFLWCGGTFRGWWNEQRMWLYRRTSSFLFGFMDTIKKLLGVSESAF
OsCslE1    (568)  YGLYFALLSGDTLKGWWNGQRMWMVKSITSYLYGFIDTIRKCVGMSKMSF
OsCslE5    (462)  QFLYFALLSGDTLKGCWNGQRMWMVRRITSYLYDLIDTIRKLLGLSKMTF
AtCslG1    (581)  QDLSDFLLEGGTYRKWWNDQRMLMEKGLSSFFFGFIEFILKTLNLSTPKF
AtCslG2    (569)  QDLSDFLLEGGTYRKWWNDQRMWMVRGLSSFFFGFTEFTLKTLNLSTQGY
AtCslG3    (586)  QDLLDFVLEGGTYGGWWNDQRMWSLRGFSSHLFGFIEFTLKTLNLSTHGT
AtCslC12   (551)  LNILPAPKSFPFIVPYLLFENTMSVTKFNAMVSGLFQ------LGSAYEW
OsCslC1    (543)  LNILPAPKSFPFIVPYLLFENTMSVTKFNAMISGLFQ------LGSAYEW
OsCslC7    (424)  LNILPAPKSFPFIVPYLLFENTMSVTKFNAMISGLFQ------LGSAYEW
OsCslC9    (448)  LNILPSPKSFPFIIPYLLFENTMSVTKFNAMISGLFQ------LGNAYEW
AtCslC5    (537)  LNLLPSPKSFPFIVPYLLFENTMSVTKFNAMVSGLFQ------LGSSYEW
AtCslC8    (537)  LNILPAPKSFPFIVPYLLFENTMSVTKFNAMVSGLFQ------LGSSYEW
OsCslC3    (571)  LNILPAPKSFPFVIPYLLFENTMSVTKFNAMVSGLFQ------LGSSYEW
OsCslC2    (543)  LNILPSPRSFPFIVPYLLFENTMSVTKFNAMVSGLFK------LGSSYEW
AtCslC4    (509)  LNILPSPKSFPFLVPYLLFENTMSITKFNAMISGLFQ------FGSAYEW
AtCslC6    (531)  LNIIPAPRSFPFIVPYLLFENTMSVTKFGAMISGLFK------FDSSYEW
OsCslA8    (396)  SSTPPAPR-------APAISSSGSSSRTSCPCTGPRP------RSSACSR
OsCslA2    (403)  MNALRNPGSVHLMPFWILFENVMAMHRMRAALSGLLE------TARANDW
OsCslA4    (423)  MNALRNPGSIHLMPFWILFENVMAMHRMRAALTGLLE------TMNVNQW
OsCslA5    (445)  VTALRNPENLHTVPLWILFESVMSMHRLRAAVAGILQ------LQEFNQW
OsCslA7    (460)  ITTLRNPRNLHIMPFWILFESVMTVLRMRAALTGLME------LSGFNKW
OsCslA3    (486)  LHALRNTSSIHFLPFWILFENVMSFHRTKAMFIGLLE------LGGVNEW
OsCslA11   (453)  CKAVGTPSSFHLVILWVLFENVMSLHRIKAAVTGILE------AGRVNEW
OsCslA6    (412)  LHSVGTPRSIHLIILWFLFENVMALHRLKATLIGFFE------AGRANEW
AtCslA1    (283)  FHTLATPRSFYLVIFWVLFENVMAMHRTKGTCIGLLE------GGRVNEW
AtCslA10   (433)  CIVLATPRSFYLVIFWILFENVMSMHRTKGTFIGILE------RQRVNEW
AtCslA15   (422)  LSALATPRSFYLVIFWILFENVMAMHRTKGTLIGLFE------GGRVNEW
AtCslA11   (324)  FNALATPRSFYLVIFWVLFENVMAMHRTKGTFIGLLE------GGRVNEW
AtCslA14   (406)  LNALATPKSFYLILYWILFENVMAMHRSIGTLIGLLE------TSRVKEW
AtCslA3    (431)  LNALATPRSLHLLVFWILFENVMSMHRTKATFIGLLE------AGRVNEW
AtCslA7    (430)  LIAIGRLRSIHLLAFWVLFENAMSLLRAKALVMGLFE------TGRVQEW
AtCslA2    (408)  LNSVGTPRSIHLLFYWILFENVMSLHRTKATIIGLFE------AGRANEW
PoXylS     (408)  LNSVGTPRSFHLLFYWVLFENVMSFHRTKATIIGLLE------AARVNEW
OsCslA1    (395)  LNSVGTPRSFHLLFFWILFENVMSLHRTKATLIGLLE------AGRANEW
OsCslA9    (403)  LNSIGTPRSLHLLIFWILFENVMSLHRTKATLIGLLE------TGRVNEW
AtCslA9    (408)  LNAVGTPRSLHLMVFWILFENVMSLHRTKATFIGLLE------AGRVNEW
PtCslA1    (406)  LNAVSTPKSLHLLVFWILFENVMSLHRTKATFIGLLE------AGRVNEW
PtCslA2    (410)  LNAVSTPRSLHLLVFWILFENVMSLHRTKATFIGLFE------AGRVNEW
CtManS     (402)  LNAVSTPRSMHLLVLWILFENVMSLHRTKAALGLLE-------ANRVNEW
PpCslA1    (400)  LNAITTPKSLHLLVFWILFENVMSLHRTKATIIGLFD------IGNVNEW
Consensus (1251)  L ILE   SG I WW  EQ W I  SA L AL     LKVLAG    F
                  1301                                            1350
AtCesA1    (955)  TVTSKAT--------------------DEDGDFAELYIFK----------
AtCesA10   (942)  TVISKAS--------------------DEDGDFAELYVFK----------
```

Figure 5QQ

```
ZmCesA1   (949) TVTSKAS---------------------DEDGDFAELYVFK----------
ZmCesA2   (948) TVTSKAS---------------------DEDGDFAELYVFK----------
ZmCesA3   (943) TVTSKAT---------------------DDDGDFAELYVFK----------
AtCesA2   (959) TVTSKAA---------------------DDGAFSELYIFK----------
AtCesA9   (963) TVTSKAA---------------------DDGEFSELYIFK----------
AtCesA5   (945) TVTSKAA---------------------DDGEFSELYIFK----------
AtCesA6   (960) TVTSKAA---------------------DDGEFSDLYLFK----------
ZmCesA6   (934) TVTSKGG---------------------DEEFSELYTFK----------
ZmCesA7   (961) TVTSKGG---------------------DEEFSELYTFK----------
ZmCesA8   (969) TVTSKAG---------------------DEEFSELYTFK----------
AtCesA3   (940) TVTSKAS---------------------DEDGDFAELYLFK----------
ZmCesA4   (952) TVTSKAS---------------------DEDGDFAELYMFK----------
ZmCesA9   (954) TVTSKAS---------------------DEDGDFAELYMFK----------
ZmCesA5   (951) TVTSKAT---------------------DEEGDFAELYMFK----------
AtCesA7   (902) TVTSKAT---------------------DDDDFGELYAFK----------
ZmCesA12  (926) TVTSKATG--------------------DEDDEFAELYAFK----------
ZmCesA13  (926) TVTSKATG--------------------DEDDEFAELYAFK----------
AtCesA4   (890) TVTSKGAS--------------------DEADEFGDLYLFK----------
ZmCesA10  (952) TVTSKAAG--------------------DEADAFGDLVLFK----------
AtCesA8   (859) TVTSKTA---------------------DDLEFGELYIVK----------
ZmCesA11  (858) TVTAKAT---------------------DDTEFGELYLFK----------
AtCslD1   (914) TLTSKA-------------------SGEDEDDIFADLYIVK----------
AtCslD2  (1021) TLTSKS-------------------GGDDIDDEFADLYMVK----------
AtCslD3  (1021) TLTSKS-------------------GGEDVDDEFADLYIVK----------
OsCslD2  (1046) TLTSKS-------------------GGDEADDEFADLYIVK----------
OsCslD1  (1001) TLTSKQ-------------------LGDDVDDEFAELYAVK----------
AtCslD4   (982) TLTTKS-------------------GGDDNEDIYADLYIVK----------
OsCslD3  (1021) TLTAKA-------------------AADDNEDIYADLYIVK----------
AtCslD5  (1057) TLTSKS--S----------------APEDGDDEFADLYVVK----------
AtCslD6   (856) TLTSKSST-----------------GGDDEDDEFADLYLFK----------
OsCslF7   (705) KLTSKHLASSA--------------TPVAGKDRQYAELYAVR----------
OsCslF1   (722) RLTSKQ-------------------TAASSGDKFADLYTVR----------
OsCslF2   (752) RLTSKQ-------------------TTASSGDKFADLYTVR----------
OsCslF4   (753) RLTSKQ-------------------TTASSGDKFADLYTVR----------
OsCslF3   (746) RVTSKQ-------------------TTADTNDKFADLYEMR----------
AtCslB1   (591) IVKKTM-PKTMSGSGSE--KSQREVDCPNQDSGKFEFD----------
AtCslB2   (634) IVTKKTM-PETKSGSGSK--KSQREVDCPNQDSGKFEFD----------
AtCslB4   (633) LVSKKTMPVETMSGSGIG--PSQREDDGPN--SGKTEFD----------
AtCslB3   (625) ILTKKTV-AGTKSALGSG--PSQGEDVGPNSDLFKFEFD----------
AtCslB5   (632) VLAKKTI-PETKSVYESK--PSQGEDDVPKLNLGKFEFD----------
AtCslB6   (706) IVAKKNM-PETRSGYESKSKPSQGEDDGLKLEL----------
OsCslH1   (634) EVTRKDK------STSDG------DSNTDEPEPGRFTFD----------
OsCslH2   (645) EVTGKDK------SMSDD------DDNTDGADPGRFTFD----------
AtCslE1   (617) VLTAKVAEE----------------EAAERYKEEVMEFGV----------
OsCslE1   (618) EVTAKVSGH----------------DEAKRYEQEILEFGS----------
OsCslE5   (512) AVTAKVSNR----------------DEAKRYKQEIIELGS----------
AtCslG1   (631) NVTSKANDDD---------------EQRKRYEQEIFDFGT----------
AtCslG2   (619) NVTSKSNDDN---------------EQMKRYEQEIFDFGP----------
AtCslG3   (636) NVTSKANDDE---------------EQSKRYEKEIFEFGP----------
AtCslC12  (595) VVTKKSGRSS---------------EGDLAALVEKDEKTT----------
OsCslC1   (587) VVTKKSGRSS---------------EGDLVSLVEKQPKQQ----------
OsCslC7   (468) VVTKKSGRSS---------------EGDLVGLVEKHSKQQ----------
OsCslC9   (492) VVTKKSGRSS---------------EGDLISLAPKELKHQ----------
AtCslC5   (581) IVTKKAGRSS---------------ESDLLSLTEKETPTK---KSQL
```

Figure 5RR

```
AtCslC8    (581)  IVTKKAGRSS------------------ESDLLAITDKESEKM---PNQI
OsCslC3    (615)  VVTKKAGRTSS-----------------ESDILAIAEAADADARPPPAKL
OsCslC2    (587)  IMTKKSGRSS------------------ESDLSTAVERDTKDLT--LPRL
AtCslC4    (553)  VVTKKTGRSS------------------ESDLLAFAEKEEKLHR------
AtCslC6    (575)  VVTKKLGRSS------------------EADLVAYAESGSLVESTTIQ--
OsCslA8    (434)  PPAPTSGSSPT-----------------SEATPTPSTSSQLIPP---P--
OsCslA2    (447)  VVTEKVGDQV------------------KDEL------------------
OsCslA4    (467)  VVTEKVGDHV------------------KDKL------------------
OsCslA5    (489)  IVTKKVGNNA------------------FDEN------------------
OsCslA7    (504)  TVTKKIGSSV------------------ED--------------------
OsCslA3    (530)  VVTEKLGNGS------------------NTKP------------------
OsCslA11   (497)  VVTEKLGDAN------------------KTKPDTNGSDAVKVID------
OsCslA6    (456)  IVTQKLGNIQ------------------KLKS------------------
AtCslA1    (327)  VVTEKLGDAL------------------KSKLL-----------------
AtCslA10   (477)  VVTEKLGDAL------------------KTKLL-----------------
AtCslA15   (466)  VVTEKLGDTL------------------NTKLL-----------------
AtCslA11   (368)  VVTEKLGDAL------------------ITKLL-----------------
AtCslA14   (450)  IVTQKLGE--------------------SNNLR-----------------
AtCslA3    (475)  VVTEKLGDTL------------------KSKLI-----------------
AtCslA7    (474)  VVTEKLGDTL------------------KTKLI-----------------
AtCslA2    (452)  VVTAKLGSGQ------------------SAKGN-----------------
PoXylS     (452)  VVTEKLGDAL------------------KNKSK-----------------
OsCslA1    (439)  VVTEKLGNAL------------------KMKSS-----------------
OsCslA9    (447)  VVTEKLGDAL------------------KLKLP-----------------
AtCslA9    (452)  IVTEKLGDVK------------------AKS-------------------
PtCslA1    (450)  VVTEKLGDAM------------------KHK-------------------
PtCslA2    (454)  VVTEKLGDAL------------------KHK-------------------
CtManS     (446)  VVTEKLGNAM------------------KQR-------------------
PpCslA1    (444)  VVTEKLGNLM------------------KYRSAKY-------GK------
Consensus (1301)  VTSK G                      D    ELY
                                                                   1400
                 1351
AtCesA1    (975)  -WTALLIPPTTVLLVNLIGIVAG--VSYAVNSGYQSWGPLFGK---LFFA
AtCesA10   (962)  -WTSLLIPPTTILLVNLVGIVAG--VSYAINSGYQSWGPLMGK---LFFA
ZmCesA1    (969)  -WTSLLIPPTTVLVINLVGMVAG--ISYAINSGYQSWGPLFGK---LFFS
ZmCesA2    (968)  -WTSLLIPPTTVLVINLVGMVAG--ISYAINSGYQSWGPLFGK---LFFS
ZmCesA3    (963)  -WTTLLIPPTTVLVINLVGIVAG--VSYAINSGYQSWGPLFGK---LFFA
AtCesA2    (978)  -WTTLLIPPTTLLIINIIGVIVG--VSDAISNGYDSWGPLFGR---LFFA
AtCesA9    (982)  -WTSLLIPPTTLLIINIVGVIVG--VSDAINNGYDSWGPLFGR---LFFA
AtCesA5    (964)  -WTSLLIPPTTLLIINVIGVIVG--ISDAISNGYDSWGPLFGK---LFFA
AtCesA6    (979)  -WTSLLIPPMTLLIINVIGVIVG--VSDAISNGYDSWGPLFGK---LFFA
ZmCesA6    (953)  -WTTLLIPPTTLLLNFIGVVAG--ISNAINNGYESWGPLFGK---LFFA
ZmCesA7    (980)  -WTTLLIPPTTLLLNFIGVVAG--VSNAINNGYESWGPLFGK---LFFA
ZmCesA8    (988)  -WTTLLIPPTTLLLNFIGVVAG--ISNAINNGYESWGPLFGK---LFFA
AtCesA3    (960)  -WTTLLIPPTTLLIVNLVGVVAG--VSYAINSGYQSWGPLFGK---LFFA
ZmCesA4    (972)  -WTTLLIPPTTILIINLVGVVAG--ISYAINSGYQSWGPLFGK---LFFA
ZmCesA9    (974)  -WTTLLIPPTTILIINLVGVVAG--ISYAINSGYQSWGPLFGK---LFFA
ZmCesA5    (971)  -WTTLLIPPTTILIINLVGVVAG--ISYAINSGYQSWGPLFGK---LFFA
AtCesA7    (921)  -WTTLLIPPTTVLIINIVGVVAG--ISDAINNGYQSWGPLFGK---LFFS
ZmCesA12   (947)  -WTTLLIPPTTLLIINVIGVVAG--ISDAINNGYQSWGPLFGK---LFFA
ZmCesA13   (947)  -WTTLLIPPTTLLIINIIGVVAG--ISDAINNGYQSWGPLFGK---LFFA
AtCesA4    (911)  -WTTLLIPPTTLIILNMVGVVAG--VSDAINNGYGSWGPLFGK---LFFA
ZmCesA10   (973)  -WTTLLVPPTTLIIINMVGVVAG--VSDAVNNGYGSWGPLFGK---LFFS
AtCesA8    (878)  -WTTLLIPPTSLLIINLVGVVAG--FSDALNKGYEAWGPLFGK---VFFA
ZmCesA11   (877)  -WTTVLIPPTSILVINLVGVVAG--FSAALNSGYESWGPLFGK---VFFA
```

Figure 5SS

```
AtCslD1   (936)  -WTGLFIMPLTIIVNLVAIVIG--ASRTIYSVIPQWGKLMGG---IEFS
AtCslD2   (1043) -WTSLMIPPITIIMVNLIAIAVG--FSRTIYSVVPQWSKLIGG---VEFS
AtCslD3   (1043) -WTSLMTPPITIMMVNLIAIAVG--FSRTIYSVIPQWSKLIGG---VEFS
OsCslD2   (1068) -WTSLMIPPIVIMMVNLIATAVG--FSRTIYSEIPQWSKLLGG---VEFS
OsCslD1   (1023) -WTSLMIPPLTIIMINLVAIAVG--FSRTIYSTIPQWSKLLGG---VEFS
AtCslD4   (1004) -WSSLMIPPIVIAMVNIIAIVVA--FIRTIYQAVPQWSKLIGG---AEFS
OsCslD3   (1043) -WSSLLIPPITIGMVNIIAIAFA--FARTIYSDNPRWGKFIGG---GFFS
AtCslD5   (1080) -WSFLMVPPLTIMMVNMIAIAVG--LARTLYSPFPQWSKLVGG---VEFS
AtCslD6   (880)  -WTALMIPPLTIITLNIVAILFA--VCRTVFSANPQWSNLLGG---TFTA
OsCslF7   (733)  -WTALMAPTAAALAVNVASMAAAGGGGRWWWWDAPSAAAAAAALPVAFN
OsCslF1   (744)  -WVPLLIPTIVIMVVNVAAVGVA-VGKAAAWG--PLTEPGWLAVLGMVEN
OsCslF2   (774)  -WVPLLIPTIVIIVVNVAAVGVA-VGKAAAWG--PLTEPGWLAVLGMVEN
OsCslF4   (775)  -WVPLLIPTIVVLAVNVGAVGVA-VGKAAAWG--LLTEQGRFAVLGMVEN
OsCslF3   (768)  -WVPMLIPTMVVLVANIGAIGVA-IGKTAVYMGVWTIAQKRHAAMGLLEN
AtCslB1   (627)  -GSLYFLEGTFILLVNLAALAGCSVGLQR------HRGGG-SGLAEACGC
AtCslB2   (670)  -GSLYFLEGTFIVLVNLAALAGCLVGLQS------RGGGG-SGLAEACGC
AtCslB4   (668)  -GSLYFLEGTFIVLVNLAALAVGVFVGLQRSSY--SHGGGG-SGLGEACAC
AtCslB3   (661)  -GSLCFLEGTFIVLVNIAALAVFSVGLQRSSY--SHEGGG-SGLAEACGC
AtCslB5   (668)  -SSGLFLEGTFIMLVNLAAGYLVRLQRSSC--SHGGGG-SGLAEACGC
AtCslB6   (738)  ------------------------AGFLVRLQRSSY--SHGGGGGSALAETCGC
OsCslH1   (661)  -ESTVFIPVTAIAMLSVIATAVGAWRVVLVTT--EGLPGG-PGISEFISC
OsCslH2   (672)  -SLPVFIPVTALAMLNIVAVTVGACRVAFGTA--EGVPCA-PGIGEFMCC
AtCslE1   (641)  -ESPMFIVLGTIGMLNLFCFAAAVARLVSGDG----GDLK-TMGMQFVIT
OsCslE1   (642)  -SSPEYVIIATVALLNEVCLVGGLSQIMAGVWN---MPWN-VFLPQAILC
OsCslE5   (536)  -SYPEYVIIVIVALLNLVCLVEVLSQIMTGVWN---MPWN-VFLTQVTLC
AtCslG1   (656)  -SSSMFLPLTTVAIVNLLAFVWGLYGILFCGG---------ELYLELMLV
AtCslG2   (644)  -SSSMFLPITTVATMNLLAFMRGLYGIFTWGE---------GPVLELMLA
AtCslG3   (661)  -SSSMFLPLTTVAIVNLLAFVWGLYGLFAWGE---------GLVLELMLA
AtCslC12  (620)  -KHQRGVSAPETEAEKKAEKTK--------------RKKKKHNRIYM
OsCslC1   (612)  -RVGSAPNLDSLAK-ESHPKKD--------------SKKKKHNRIYQ
OsCslC7   (493)  -RVGSAPNLDALTKEESNPKKD--------------SKKKKHNRIMR
OsCslC9   (517)  -KIESAPNLDATAKEQSAPRKD--------------VKKK-LNRIYK
AtCslC5   (610)  LRGVSDSELLELSQLEEQKQAVS--------------KKPVKKTNKIYH
AtCslC8   (610)  LRGVSDSELLELSQVEEQKKQP--------------VSVKKTNKIPH
OsCslC3   (648)  HRGVSEGGLKEWAKLHKEQEDATAAAAAAAPGTPVKKSKAAKAPNRLEK
OsCslC2   (617)  QKQISESELIDLKMQKERQEKAP-------------LGAKKANKIYK
AtCslC4   (579)  --RNSESGLELLSKLKEQETNLVGQETVKKSLGGLMR-PKNKKKTNMVEK
AtCslC6   (605)  -RSSSDSGLTELSKIGAAKKAG---------------KTKRNRLYR
OsCslA8   (462)  GLGGRPPLAPAAQASSEMTSMSP--------------RSSWGPACST
OsCslA2   (461)  ------------DVPLLEPLKP--------------TECAERLYI
OsCslA4   (481)  ------------EVPLLEPLKP--------------TDCVERLYI
OsCslA5   (503)  ------------NETPLLQKSR--------------KRLINRVNL
OsCslA7   (516)  ------------TQVPLLPKTR--------------KRLRDRINL
OsCslA3   (544)  ------------ASQILERP-P--------------CRFWDRWTM
OsCslA11  (523)  --------VELTTPLIPKLKKRR--------------TRFWDKYHY
OsCslA6   (470)  ------------I--VRVTKN---------------CRFKDREHC
AtCslA1   (342)  ------------SRVVQ-RKS---------------CYQRVNS
AtCslA10  (492)  ------------PRIGKPSNM---------------FLERVNS
AtCslA15  (481)  ------------PQNGR-------------------LPKRVNL
AtCslA11  (383)  ------------PQVRKPRNG---------------FLERINS
AtCslA14  (463)  ------------ENLIFPDHY---------------SFPERLRW
AtCslA3   (490)  ------------GKATTKLYT---------------RFGQRLNW
AtCslA7   (489)  ------------PQVPN---V---------------RFRERVHL
AtCslA2   (467)  ------------TKGIKRFPRI--------------FKLPDRLNT
```

Figure 5TT

```
PoXylS      (467)  ------------SAAPRRS-LT--------------------KILGDRLQL
OsCslA1     (454)  ------------SKSSAKKSF--------------------MRVWDRLNV
OsCslA9     (462)  ------------GK-AFRRPR--------------------MRIGDRVNA
AtCslA9     (465)  -------------ATKTSKKVIR------------------FRFGDRLHV
PtCslA1     (463)  -------------SGKQLKKSR-------------------SRIGERLHV
PtCslA2     (467)  -------------TAKQMKRSQ-------------------SRIGERLHV
CtManS      (459)  ------------NNARPSRASR-------------------FRIIERLHP
PpCslA1     (463)  --------KYTLQRMASNMLARG------------------WKMSERLHI
Consensus  (1351)      T  L  IP    I  IVNLVAV    G                K    IF
                    1401                                              1450
AtCesA1    (1019)  LWVIAHLYPELKGLLGRQN--RTPTIVIVWSVLLASIFSLLWVRINPFVD
AtCesA10   (1006)  FWVVAHLYPELKGLLGRQN--RTPTIVIVWSALLASIFSLLWVRINPFVS
ZmCesA1    (1013)  IWVILHLYPELKGLMGRQN--RTPTIVIVWSTLLASIFSLLWVKIDPFIS
ZmCesA2    (1012)  IWVILHLYPELKGLMGRQN--RTPTIVIVWSILLASIFSLLWVKIDPFIS
ZmCesA3    (1007)  IWVILHLYPELKGLMGRQN--RTPTIVIVWSVLLASIFSLLWVKIDPFIS
AtCesA2    (1022)  LWVIVHLYPELKGMLGKQD--KMPTIIVVWSILLASILTLLWVRVNPFVA
AtCesA9    (1026)  LWVIVHLYPELKGLLGKQD--RVPTIILVWSILLASILTLLWVRVNPFVS
AtCesA5    (1008)  FWVILHLYPELKGLLGKQD--RMPTIIVVWSILLASILTLLWVRVNPFVA
AtCesA6    (1023)  LWVIIHLYPELKGLLGKQD--RMPTIIVVWSILLASILTLLWVRVNPFVA
ZmCesA6     (997)  FWVIVHLYPELKGLVGRQN--RTPTIVIVWSILLASIFSLLWVRIDPFLA
ZmCesA7    (1024)  FWVIVHLYPELKGLVGRQN--RTPTIVIVWSILLASIFSLLWVRIDPFLA
ZmCesA8    (1032)  FWVIVHLYPELKGLVGRQN--RTPTIVIVWSILLASIFSLLWVRVDPFLA
AtCesA3    (1004)  FWVIVHLYPELKGLMGRQN--RTPTIVVVWSVLLASIFSLLWVRIDPFTS
ZmCesA4    (1016)  FWVIVHLYPELKGLMGRQN--RTPTIVVVWAILLASIFSLLWVRIDPFTT
ZmCesA9    (1018)  FWVIVHLYPELKGLMGRQN--RTPTIVVVWAILLASIFSLLWVRIDPFTN
ZmCesA5    (1015)  FWVIVHLYPELKGLMGKQN--RTPTIVVVWAILLASIFSLMWVRIDPFTT
AtCesA7     (965)  FWVIVHLYPELKGLMGRQN--RTPTIVIWSVLLASIFSLLWVRIDPFVL
ZmCesA12    (991)  FWVIVHLYPELKGLMGRQN--RTPTVVVIWSILLASIFSLLWVRIDPFIV
ZmCesA13    (991)  FWVIVHLYPELKGLMGRQN--RTPTIVIWSVLLASIFSLLWVRIDPFIV
AtCesA4     (955)  FWVIVHLYPELKGLMGRQN--RTPTIVLWSILLASIFSLVWVRIDPFLP
ZmCesA10   (1017)  FWVIVHLYPELKGLMGRQN--RTPTIVLWSILLASIFSLVWVRIDPFIP
AtCesA8     (922)  FWVILHLYPELKGLMGRQN--RTPTIVILWSILLASVFSLWVRINPFVS
ZmCesA11    (921)  MWVIMHLYPELKGLMGRQN--RTPTIVLWSVLLASVFSLLWVKIDPFVG
AtCslD1     (980)  LWVLTHMYPEAKGLMGRRG--KVPTIVYVWSGLVSITVSLLWITISPPDD
AtCslD2    (1087)  FWVLAHLYPEAKGLMGRRG--RTPTIVYVWSGLVAITISLLWVAINPP--
AtCslD3    (1087)  FWVLAHLYPEAKGLMGRRG--RTPTIVYVWSGLVAITISLLWVAINPP--
OsCslD2    (1112)  FWVLAHLYPEAKGLMGRRG--RTPTIVFVWSGLLAITISLLWVAINPP--
OsCslD1    (1067)  FWVLAHLYPEAKGLMGRRG--RTPTIVYVWSGLVAITISLLWIAKPPS-
AtCslD4    (1048)  FWVLAHLYPEAKGLMGRRG--KTPTIVFVWAGLIAITISLLWTAINPNTG
OsCslD3    (1087)  FWVLAHLNPEAKGLMGRRG--RTPTIVFVWSGLLSITVSLLWVAISPPE-
AtCslD5    (1124)  FWVLCHLYPEAKGLMGRRG--RVPTIVFVWSGLLSIIVSLLWVYINPP--
AtCslD6     (924)  SWVLIHMYPEAKGLMGRGG--KTPTVVYVWSGLIAICLSLLYITIKNS--
OsCslF7     (782)  VWVVVHLYPEALGLMGRRSK-AVRPILFLFAVVAYLAVRFLCLLLQFHTA
OsCslF1     (790)  VWILVLLYPEALGVMGQWG--KRPAVLFVAMAMAVAAVAAMYVAFGAPYQ
OsCslF2     (820)  VWILVLLYPEALGVMGQWG--KRPAVLFVAMAMAVAAVAAMYVAFGAPYQ
OsCslF4     (821)  VWILALLYPEALGIMGQRG--KRPAVLFVATVMAVAAVAIMYAAFGAPYQ
OsCslF3     (816)  MWVMFLLYPEALAIMGRWA--KRSIILVLLPIIFVIVALVYVATHILLA
AtCslB1     (669)  ILVVILFLPELKGMFEK-G--KYGIP--WSTLSKAAFLAVLFVVFSVGN-
AtCslB2     (712)  ILVVILFLPELKGMFEK-G--KYGIP--FSTLSKAAFLAALFVVLSVGN-
AtCslB4     (714)  ILVVMLFFPELKGLFAK-G--KYGIP--LSTLSKAGFLAVSFVVFSVGN-
AtCslB3     (707)  VLVMMLFLPELMGLFKK-G--KYGTP--LSTLSIAGFLAVLFVVFSV---
AtCslB5     (714)  ILVVMLFLPELKGLFEH-G--KYSIP--LSTLSKAAFLTVLFVFFCVGK-
AtCslB6     (766)  AMIVFGENDGSQEGLEL-P--KLNSKRGLSSIVEKTFVACLLPFVRNHKV
OsCslH1     (707)  GWLVLCFMPLLRGLVGS-G--RYGIP--WSIKMKACLLVAIFLLFCKRN-
```

Figure 5UU

```
OsCslH2    (718)  GWLVLCFFPHVRGIVWGKG--SYGIP---WSVKLKASLLVAMFVTFCKRN-
AtCslE1    (685)  GVLVVINWGLYKGMLLRQDKGKMPMSVTVKSVV------------------
OsCslE1    (687)  GMIVIINMPIYEAMFLRKDNGRIPTAVTLASIG------------------
OsCslE5    (581)  GMIVITSIPIYEAMFLRKDKGRIPSSVTLASLG------------------
AtCslG1    (696)  SFAVVNCLPIYGAMVLRKDDGKLSKRTCFLAGNLHVGSYCVKLLRPQVTS
AtCslG2    (684)  SFAVVNCLPIYEAMVLRIDDGKLPKRLCFLAG-------------------
AtCslG3    (701)  SFAVVNCLPIYEAMVLRIDDGKLPKRVCFVAG-------------------
AtCslC12   (652)  KELSLAFLLLTAATRSLLS---AQGIHFYFLLFQGISFLVGLDLIGEQV
OsCslC1    (643)  KELALSFLLLTAAARSLLS---VQGIHFYFLLFQGVSFLVVGLDLIGEQV
OsCslC7    (525)  KELAISFLLLTAAARSLLS---AQGIHFYFLLFQGVSFLVVGLDLIGEQV
OsCslC9    (548)  KELALSLLLLTAAARSLLS---KQGIHFYFLLFQGISFLVGLDLIGEQI
AtCslC5    (645)  KELALAFLLLTAALRSLLA---AQGVHFYFLLFQGVTFLVGLDLIGEQM
AtCslC8    (643)  KELALAFLLLTAAVRSLLA---SQGVHFYFLLFQGLTFLLVGLDLIGEQM
OsCslC3    (698)  KELALAFLLLTAATRSLLS---AQGIHFYFLLFQGVTFLAVGLDLIGEQV
OsCslC2    (651)  KELALSLLLLTAATRSLLS---AQGIHFYFLLFQGVSFLFVGLDLIGEQI
AtCslC4    (626)  KELGLAFLLLTAAARSFLS---AHGIHFYFLLFQGLSFLVVGLDLIGEQI
AtCslC6    (635)  TEIALAFILLAASVRSLLS---AQGIHFYFLLFQGITVVIVGLDLIGEQV
OsCslA8    (495)  APSTTSPTAATASTSTCSSS---RPPPSSSASATSGPSSYYYSYSTCIHV-
OsCslA2    (480)  PELLIALVLLICASYDFVLG---NHKYYIYIYLQAVAFTVMGFGFVGTRT
OsCslA4    (500)  PELMVAFVLLVCASYDLVLG---AKHYYLYIYLQAFAMIALGFGFAGTST
OsCslA5    (522)  PEIGLSVFLIFCASYNLVFH---GKNSFYINLYLQGLAFFLIGLNCVGTLP
OsCslA7    (535)  PEIGFSVFLIFCASYNLIFH---GKTSYVFNLYLQGLAFLLLGFNFTGNFA
OsCslA3    (562)  SEIIFSIFLFFCATYNLAYG---GDYYFVYIYLQAIAFLVVGIGFCGTIS
OsCslA11   (547)  SEIFVGICIILSGFYDVLY---AKKGYYIFLFIQGLAFLIVGFDYIGVCP
OsCslA6    (486)  LELFTGGFLLTSACYDYLYR---DDIFYIFLLSQSIIVFAIGFEFMGVSV
AtCslA1    (357)  KEVMVGVYILGCALYGLIY---GHTWLHFYLFLQATAFFSGFGFVGT--
AtCslA10   (508)  KEIMVGIYILCCACYGLFF---GNTLYLYLFLMQAVAFLISGVGFVGT--
AtCslA15   (493)  KEMMMGIYILCCACYDFAF---GNAFLYLYLFMQATAFLISGVGFVGT--
AtCslA11   (399)  KEMMVGIYILCCASYNLVF---GKTVLYIYLYMQALAFIIAGIGFIGT--
AtCslA14   (480)  REIMVGMYLFICGYYDFVF---GRTYLYVVYLFQSIAFFVGVGYVGMPV
AtCslA3    (507)  RELVGLYIFFCGCYDFAY---GGSYFVVYLFQSCAFFVAGVGYIGTFV
AtCslA7    (503)  LELLVGAYLLFCGIYDIVY---GKNTLYVVYLFQSVAFFVVGFGFVGKYV
AtCslA2    (486)  LELGFAAFLFVCGCYDFVH---GKNNYFIYLFLQTMSFFISGLGWIGTYV
PoXylS     (485)  QELGFAVFLFICGCFDYVY---GKNYYFVYFWLQVVTFTIAGFGYIGTIV
OsCslA1    (472)  TELGVAAFLFSCGWYDLAF---GKDHFFIYLFFQGAAFFIVGIGYVGTIV
OsCslA9    (479)  LELGFSAVLSFCGCYDIAY---GKGYYSLFLFLQSITFFIIGVGYVGTIV
AtCslA9    (484)  LELGVGMYLLFVGCYDAFF---GKNHYYLYLFAQAIAFFLAGFGQIGTIV
PtCslA1    (481)  LELFAGVYLLFCASYDLAF---GRNHFYIYLYLQAAAFFVMGFGYIGTFV
PtCslA2    (485)  LEVLTGVYLLFCASYDLAF---GKNHFYIYLFLQAGAFFIMGFGYIGTFV
CtManS     (478)  LEIIVGMYMLHCATYDLLF---GHDHFFVYLLLQAGAFFTMGFGLVGTIV
PpCslA1    (487)  LELWTGGFLMFCAVYDFYFQ--GKNHFYVYLFLQSCAFLIMGFGYVGTFV
Consensus  (1401)      VIV LYPF  GLM R     R   IVFVW LL A   F LLWV I
                    1451                          1489
AtCesA1    (1067) ANPNANNFNGKGGVF-----------------------
AtCesA10   (1054) TTGVMSNSFMGE---------------------------
ZmCesA1    (1061) PTQKAAALGQCGVNC------------------------
ZmCesA2    (1060) PTQKAAALGQCGVNC------------------------
ZmCesA3    (1055) PTQKALSRGQCGVNC------------------------
AtCesA2    (1070) K-GGPVLEICGLNCGN-----------------------
AtCesA9    (1074) K-DGPVLEICGLDCLK-----------------------
AtCesA5    (1056) K-GGPILEICGLDCL------------------------
AtCesA6    (1071) K-GGPILEICGLDCL------------------------
ZmCesA6    (1045) KDDGPLLEECGLDCN------------------------
ZmCesA7    (1072) KDDGPLLEECGLDCN------------------------
```

Figure 5VV

```
ZmCesA8   (1080)  KSNGPLLEECGLDCN-----------------------
AtCesA3   (1052)  RVTGPDIL-ECGINC------------------------
ZmCesA4   (1064)  RVTGPDTQ-TCGINC------------------------
ZmCesA9   (1066)  RVTGPDTR-TCGINC------------------------
ZmCesA5   (1063)  RVTGPDIA-KCGINC------------------------
AtCesA7   (1013)  KTKGPDTS-KCGINC------------------------
ZmCesA12  (1039)  RTKGPDVR-QCGINC------------------------
ZmCesA13  (1039)  RTKGPDVR-QCGINC------------------------
AtCesA4   (1003)  KQTGPLLKQCGVDC-------------------------
ZmCesA10  (1065)  KAKGPILKPCGVEC-------------------------
AtCesA8    (970)  KTDTTSLSLNCLLIDC-----------------------
ZmCesA11   (969)  GTETVNTNNCNTHLLIHHRSAAVVPRRTCFWCCKRGLPA
AtCslD1   (1028)  VSGSGGISV------------------------------
AtCslD2   (1133)  ---AGNTEIGGNFSFP-----------------------
AtCslD3   (1133)  ---AGSTQIGGSFTFP-----------------------
OsCslD2   (1158)  ---SQNSQIGGSFTFP-----------------------
OsCslD1   (1114)  --AQANSQLGGSFSFP-----------------------
AtCslD4   (1096)  PAAAAEGVGGGGFQFP-----------------------
OsCslD3   (1134)  -ANSNGGARGGGFQFP-----------------------
AtCslD5   (1170)  ----SGKQDYMQFQFP-----------------------
AtCslD6    (970)  ------EIDGGSFMLV-----------------------
OsCslF7    (831)  ---------------------------------------
OsCslF1    (838)  AELSGVAASLGKVAAASLTGPSG----------------
OsCslF2    (868)  AELSGGAASLGKAAAS-LTGPSG----------------
OsCslF4    (869)  AGLSGVAASLGKAASL--TGPSG----------------
OsCslF3    (864)  NIIPF----------------------------------
AtCslB1    (713)  ---------------------------------------
AtCslB2    (756)  ---------------------------------------
AtCslB4    (758)  ---------------------------------------
AtCslB3    (749)  ---------------------------------------
AtCslB5    (758)  ---------------------------------------
AtCslB6    (813)  NEKKNHHINIDRPNLL-----------------------
OsCslH1    (751)  ---------------------------------------
OsCslH2    (763)  ---------------------------------------
AtCslE1    (718)  ----LALSACTCLAFL-----------------------
OsCslE1    (720)  ----FVMLAFLVPIV------------------------
OsCslE5    (614)  ----FVMLAFLIKY-------------------------
AtCslG1    (746)  PLRLIHNNNTSGWFKRKKHNMNESV--------------
AtCslG2    (716)  -LLSFVLTG-SGYFFLK----------------------
AtCslG3    (733)  -ILTFVLIV-SGYVFLK----------------------
AtCslC12   (699)  E--------------------------------------
OsCslC1    (690)  E--------------------------------------
OsCslC7    (572)  E--------------------------------------
OsCslC9    (595)  E--------------------------------------
AtCslC5    (692)  S--------------------------------------
AtCslC8    (690)  S--------------------------------------
OsCslC3    (745)  S--------------------------------------
OsCslC2    (698)  D--------------------------------------
AtCslC4    (673)  S--------------------------------------
AtCslC6    (682)  S--------------------------------------
OsCslA8    (542)  ---------------------------------------
OsCslA2    (527)  PCS------------------------------------
OsCslA4    (547)  PCS------------------------------------
OsCslA5    (570)  DHCCF----------------------------------
```

Figure 5WW

```
   OsCslA7   (583)  CCQ----------------------------------------
   OsCslA3   (609)  SNS----------------------------------------
  OsCslA11   (594)  P------------------------------------------
   OsCslA6   (533)  SS-----------------------------------------
    AtCslA1  (402)  -------------------------------------------
  AtCslA10   (553)  -------------------------------------------
  AtCslA15   (538)  -------------------------------------------
  AtCslA11   (444)  -------------------------------------------
  AtCslA14   (527)  PSTPVQTSE----------------------------------
   AtCslA3   (554)  PTV----------------------------------------
   AtCslA7   (550)  PASSYLA-------------------------------------
   AtCslA2   (533)  PS-----------------------------------------
    PoXylS   (532)  PSH----------------------------------------
   OsCslA1   (519)  PQS----------------------------------------
   OsCslA9   (526)  PH-----------------------------------------
   AtCslA9   (531)  PNH----------------------------------------
   PtCslA1   (528)  PTS----------------------------------------
   PtCslA2   (532)  PTY----------------------------------------
    CtManS   (525)  PT-----------------------------------------
   PpCslA1   (535)  PHYS---------------------------------------
 Consensus  (1451)
```

Figure 6A

```
                    1                                                50
AtCslA1       (1)   --------------------------------------------------
AtCslA10      (1)   MTTFLKSLIFLQDSCLAFLSLMFHRGSSEDAAEALKKLETSINGARISFD
AtCslA11      (1)   --------------------------------------------------
AtCslA15      (1)   MFLLLKPLLSLHDLSLNLLSVMFHG----------ETLKASVDGVGINMS
AtCslA14      (1)   -------------------------MATLSDGLFDDMSVLGV
AtCslA3       (1)   MSPFLKFFLFLYDYLSPSSFFLVQRNTLG---ASLDTTDGVVRSGIIGE
AtCslA7       (1)   ---MSPLPIFHRLPHATFSSFLLSLSQAGSSKTSVAFLNAFKSEDIIARI
AtCslA2       (1)   ----------------------MDGVSPKFVLPETFDGVRMEITGQL
PoXylS        (1)   ----------------------MAEVSGKSFLPESLPGYNPDITGQ
AtCslA9       (1)   ----------------------MELGDTTSVLPDSFMGYRDDITMQM
PtCslA1       (1)   ----------------------MDRLSSANLLPESFP--SNDMTEQL
CtManS        (1)   -------------------------MRNLLFEEPEGIPGNSSSSL
PpCslA1       (1)   ----------------------MAESGSTGGLPMLVDQL
Consensus     (1)                                     L           I  I
                    51                                               100
AtCslA1       (1)   --------------------------------------------------
AtCslA10     (51)   TTWTREFRSLFIVPLFKCLVAFCLIISLLVFIEGIYMNLVVLYVKVFERK
AtCslA11      (1)   --------------------------------------------------
AtCslA15     (41)   TMWR-ETNVFIVPLFKCIVVMCLIISLLVFVESVYMNLVVLYVKLENRK
AtCslA14     (19)   GYVLEQTRFIFLVPILKRLVNLCQVVSVLLFVDAAYMAIVWAIVKLLGRT
AtCslA3      (48)   IYIWKQTRIFVFEIPILKCLVTICLVMSLLLFIERVYMSIVVVFVKLLRET
AtCslA7      (48)   GLWAQLIRAVVVPVEKFLVLLCLVMSVMFFVEVMYMGIVVLYVKLFKRH
AtCslA2      (26)   GMIWELVKAPVIVPLLQLAVYICLLMSVMLLCERVYMGIVIVLVKLFWKK
PoXylS       (26)   GLLWELIKTPLIIPVLRLSVYICLAMSIMVFMERLYMGVVIVLVRLFWKK
AtCslA9      (26)   SMVLDQIRAPLIVPALRLGVYICLTMSVMLFVERVYMGIVISLVKLFGRK
PtCslA1      (24)   ALIWRQIRAPLIAPLLRFAVGICLIMSLMLFIERVYMAVVIVLVKLFGKR
CtManS       (21)   RYAQSTIRAPVIIPLLKLAVIVCSVMSIMLFVERVAMAAVILIVKVLRKK
PpCslA1      (18)   VKIWLEVRGPVVAPVLQFAINVCLVMVTMLFVERIFMCGVMVFVKLLRET
Consensus    (51)       IW  IR  VIVPLLK  V ICLVMSLMLFVERVYMGIVIV VKLF RK
                    101                                              150
AtCslA1       (1)   --------------------------------------------------
AtCslA10    (101)   PEKVYRWEAMQEDIFLGHE--TYPMVLVQIPMYNEKEVLQLSIGAACRLI
AtCslA11      (1)   ---------MQEDLELGNQ--NFPMVLVQIPMYNEREVEKLSIGAACRLI
AtCslA15     (90)   PEKVYKWEAMQEDMELGHQ--NYPMVLVQIPMYNEREVEELSIGAACRLT
AtCslA14     (69)   PQKVLKWESFKSDDIELAPSSNHPMVLIQIPIFNEKEVCQLSIGAACKLS
AtCslA3      (98)   PEKVHKWEPINDDLELAN-TNYPMVLVQIPMYNEKEVCQLSIGAACRLS
AtCslA7      (98)   PEKFYKWEAMEDDVECGSA--SYPMVLVQIPMYNEKEVCEQSIAAACKLS
AtCslA2      (76)   PDKRYKFEPIHDDEELGSS--NFPVVLVQIPMFNEREVYKLSIGAACGLS
PoXylS       (76)   PEQRYKWEPMEDDIEDANA--AYPIVLVQIPMFNEREVYKLSIGAACNLS
AtCslA9      (76)   PDKRFKYEPIKDDIELGNS--AYPMVLIQIPMFNEREVYQLSIGAACGLS
PtCslA1      (74)   PEKRYKWEPIRDDTELGNS--AYPMVLVQIPMYNEKEVYQLSIGAACGLS
CtManS       (71)   RYTKYNLEAMKQKLER-SK--KYPMVLIQIPMYNEKEVYKLSIGAVCGLS
PpCslA1      (68)   PETQFKFEAIQDDLEFGNS--SYPMVLVQIPMFNEREVYQLSIQAACGLS
Consensus   (101)   PEK YKWE M DDIE G      YPMVLVQIPMYNEKEVY LSIGAAC LS
                    151                   *                          200
AtCslA1       (1)   --MVDLVVQVVDDFTDPAVREGVDVEIAKWQSQGINIRCERR-DNRNGYK
AtCslA10    (149)   WPLDRLIVQVLDDSTLQTIKELVNTECAKWESKGVNIKCLRR-DNRNGYK
AtCslA11     (40)   WPLDRLIVQVLDDSTDPTIMEMVSTECGKWATKGINIKCLRR-DNRNGYK
AtCslA15    (138)   WPSDRLIVQVLDDSTDPAIMELVSMECTKWASKDININYERR-ENRNGYK
AtCslA14    (119)   WPLDRMIIQVLDDSTEEESQKLVRLECKKWEGEGITIRSEVRGGFREGEK
```

Figure 6B

```
AtCslA3    (147) WPLDRMIVQVLDDSTDPASKELVNAECDKWARKGINTMSETR-DNRIGYK
AtCslA7    (146) WPSNRIIIQVLDDSTDPASKELVKKECDRWSKEGVNITPEIR-DNRNGYK
AtCslA2    (124) WPSDRLVIQVLDDSTDPTVKQMVEVECQRWASKGINIRYQIR-ENRVGYK
PoXylS     (124) WPADRLVIQVLDDSTDFTIKDLVEKEGLRWASKGINIRYQIR-ESRGGYK
AtCslA9    (124) WPSDRIVIQVLDDSTDPTIKDLVEMECSRWASKGVNIKYEIR-DNRNGYK
PtCslA1    (122) WPSDRIIIQVLDDSTDPAIKELVTMECQRWASKGINIKYEIR-DNRNGYK
CtManS     (118) WPADRFIVQVLDDSTNPVLRELVEMECQKWIQKGVNVKYENR-RNRNGYK
PpCslA1    (116) WPQDRMIIQVLDDSTLQTTRELVQEVQRWASKGINIKYETR-PNRKGYK
Consensus  (151) WPSDRLIIQVLDDSTDP IKELV MEC KWASKGINIKYEIR DNRNGYK
                 201             #      * *                    250
AtCslA1    (48)  AGAMKEALTQSYVKQ--CDFVAVFDADFQPEPDYLIRAVPFLVHNPDVAL
AtCslA10   (198) AGALKEGMKHNYVKL--CNYVVIFDADFQPEPDYLQHSVPFLVHNPEVAL
AtCslA11   (89)  AGALKQGMRHSYVKT--CTYIAIFDADFQPEPDYLERTVPFLIHNPELAL
AtCslA15   (187) AGALKHGMRHSYVKQ--CQYIAIFDADFQPEPDYLQRALPFLIHNPEVAL
AtCslA14   (169) AGALTAGMKHSYVDEYKCEFVVIFDADFQPEPDFLERTVPFLVHNPEIAL
AtCslA3    (196) AGALKAGMHNYVKQ--CEFVAIFDADFQPDPDFLERTIPFLIHNHEISL
AtCslA7    (195) AGALREGMRHSYVKQ--CDYVAIFDADFQPDPDFLHRTVPFLIHNEKLAL
AtCslA2    (173) AGALKEGLKRSYVKH--CEYVVIFDADFQPEPDELRRSIPFLMHNENIAL
PoXylS     (173) AGALKEGLKHEYVKP--CEYVVIFDADFRPEPDELKRAVPFLIHNKDIAL
AtCslA9    (173) AGALKEGMKKSYVKS--CDYVVIFDADFQPEADFLWRTVPYLLHNEKLAL
PtCslA1    (171) AGALKEGMKRSYVKD--CDYVAIFDADFQPEPDYLWRTVPFLVHNPELAL
CtManS     (167) AGALKEGLEKQYVED--CEFVAIFDADFQPDADFLWNTIPYLLENPKLGL
PpCslA1    (165) AGALRQGMRHPYVQT--CDYVAIFDADFQPEPEELQRTVPFLVHNSNLAL
Consensus  (201) AGALKEGMKHSYVK  CDYVAIFDADFQPEPDFL RTVPFLIHNPELAL
                 251                       300
AtCslA1    (96)  VQARWIFVNANKCLMTRMQEMSLNYHFKVEQESGSTRHAFFGFNGTAGVW
AtCslA10   (246) VQARWRFMNANKCLMTRMQEMSLNYHFMAEQESGSTRHAFFSFNGTAGVW
AtCslA11   (137) VQARWKFVNAKKCLMTRMQEMSLNYHFIAEQESGSTRHAFFGFNGTAGVW
AtCslA15   (235) VQARWRFVNANTCLMTRMQEMSLNYHFMAEQQSGSTRHAFFGFNGTAGVW
AtCslA14   (219) VQLGWKYGNADECCMTRIQEMSLNYHFAVEQKSGSEILGFFGFNGTAGVW
AtCslA3    (244) VQCRWKFVNANECLMTRMQEMSLNYHFVAEQESGSEIHAFFGFNGTAGVW
AtCslA7    (243) VQGRWEFVNAGQCMMTRLQEMSLSYHFTIEQQVGSTFAFFGFNGTAGVW
AtCslA2    (221) VQARWRFVNSDECLLITRMQEMSLDYHFTVEQEVGSSTHAFFGFNGTAGIW
PoXylS     (221) VQSRWRFVNSDECLLTRMQEMSLDYHFTVEQEVGSATHAFFGFNGTGGIW
AtCslA9    (221) VQARWKFVNSDECLMTRMQEMSLDYHFTVEQEVGSSTYAFFGFNGTAGIW
PtCslA1    (219) VQARWKFVNSDECLMTRMQEMSLDYHFTVEQEVGSSTHAFFGFNGTAGVW
CtManS     (215) VQARWKFVNSEECMMTRLQEMSLDYHFSVEQEVGSSTYSFFGFNGTAGVW
PpCslA1    (213) VQARWKFVNANECLMTKMQEVSLNYHFSVEQRVGSATYGFFGFNGTAGVW
Consensus  (251) VQARWKFVNA ECLMTRMQEMSLNYHFTVEQEVGSSTHAFFGFNGTAGVW
                 301          *                       350
AtCslA1    (146) RISAMEAAGGWKSRTTVEDMDLAVRVGLHGWKFVYLNDLTVRNELPSKFK
AtCslA10   (296) RMAAMEEAGGWHDRTTVEDMDLAVRAGLLGWKFVFINDLTVKSELPSKFK
AtCslA11   (187) RLAAMEEAGGWKDRTTVEDMDLAVRVGLHGWKFVFVNDVSVKSELPSQFK
AtCslA15   (285) RMVAMEEAGGWKDRTTVEDMDLAVRVGLLGWKFIFVNDLEVKSELPSQFK
AtCslA14   (269) RLKALNEAEGWKDRTIVEDMDLAVRAYLRGSKFVYVDDVKVKNELPSSFQ
AtCslA3    (294) RIAALNEAGGWKDRTTVEDMDLAVRACLHGWKFVYHDVEVKNELPSTFK
AtCslA7    (293) RISALNESGGWNIQTTVEDMDLAVRATLRGWKFLYIDDLKVKSELPCSFK
AtCslA2    (271) RIAALNEAGGWKDRTTVEDMDLAVRASLRGWKFLYIGDLQVKSELPSTFR
PoXylS     (271) RLKAINEAGGWKDRTTVEDMDLAVRAGLKGWKFLYIGDLHVKSELPSTFK
AtCslA9    (271) RISALNEAGGWKDRTTVEDMDLAVRASLKGWKFLYIGSLKVKNELPSTFK
PtCslA1    (269) RINALNEAGGWKDRTTVEDMDLAVRASLKGWKFVFVGDLKVKNELPSTFK
CtManS     (265) RIQAIKDAGGWKDRTTVEDMDLAVRASLHGWEFVFVGDVKVKNELPSTFK
PpCslA1    (263) RIRAMEEAGGWNDRTTVEDMDLAVRASLCGWKFVYIHDLEVKNELPSTFK
Consensus  (301) RIAALNEAGGWKDRTTVEDMDLAVRA L GWKFVYV DL VKNELPSTFK
```

Figure 6C

```
              351  *   **  #  #                                      400
AtCslA1  (196) AYRFQQHRWSCGPANLFRKMTMEILENKRVSIWKKEYVIYSFFFVRKVAV
AtCslA10 (346) AFRFQQHRWSCGPANLFRKMIMELIRNKRVTIWKKLYLVYSFFFLRKIIV
AtCslA11 (237) AFRFQQHRWSCGPANLFRKMTMEIIRNKRVTIWKKLYVIYSFFFVRKLIV
AtCslA15 (335) AFRFQQHRWSCGPANLIRKMTMEIIHNKRVKIWKKEYVIYSFFFLRKIVV
AtCslA14 (319) AYRFQQHRWSCGPANLFKKIAMEIITKNQNVSLWKKKVYLIYNFFFLRKIVV
AtCslA3  (344) AYRFQQHRWSCGPANLWRKMTWLILQNKKVSAWKKLYLIYNFFFIRKIVV
AtCslA7  (343) ALRSQQHRWTCGPANLILRKMAGQIIRSENVSLWKKWYMLYSFFFMRKIVA
AtCslA2  (321) AFRFQQHRWSCGPANLFRKMVMEIVRNKKVRFWKKVYIYSFFFVRKIIA
PoXylS   (321) AFRFQQHRWSCGPANLFRKMVFDIATNKKVTLYKKEYVIYSFFFVRKIIA
AtCslA9  (321) AYRYQQHRWSCGPANLFRKMAFEIMTNKNVTLWKKVHVIYSFFFVRKLVA
PtCslA1  (319) AYRYQQHRWSCGPANLFRKMVMLILRNKRVTPWKKEHVIYAFFFVRKIVA
CtManS   (315) AYRFQQHRWSCGPANLFKKMTKLIICCARVPLLKRLHLIYAFFFVRKIVA
PpCslA1  (313) AFRFQQHRWSCGPANLFRKVLFTILKNQNLRLWKRLHMIYAFFFVRKIVA
Consensus(351) AFRFQQHRWSCGPANLFRKM MEIIRNKRVTLWKKLYVIYSFFFVRKIVA 401                                                    450
AtCslA1  (246) HFLTFFFYCIVPTSVFFPEIHIFSWSTIYVPSLISIFHTLATPRSFYLV
AtCslA10 (396) HCFTFIFYCVILPTSVFFPEVNIPAWSTFYLPSMITICIVIATPRSFYLV
AtCslA11 (287) HFFTFFFYCFILPTSVFFPEVNIPTWSTVYFPFMITIFNAIATPRSFYLV
AtCslA15 (385) HFFTYFFYCVILPTSVFLPEWNIPNWSTIYVPSVITLLSAIATPRSFYLV
AtCslA14 (369) HLFTFVFYCVILPAIVLFPEIEVPKWTTIYIPATITILNAIATPKSFYLI
AtCslA3  (394) HIFTFVFYCLILPTTVLFPELQVPKWATVYFPTTITILNAIATPRSLHLL
AtCslA7  (393) HIITFCFYCVILPATVLFPEVTVPKWAAFYLPSLITLIAIGRLPSIHLI
AtCslA2  (371) HWVTFCFYCVVLPLTILVPEVKVIIWGSVYIPSIITILNSVGTPRSLHLL
PoXylS   (371) HMFTFFFYCVVLPLICLVPEVEVPKWGAIYLPCIITVLNSVGTPRSFHLL
AtCslA9  (371) HIVTFIFYCVVLIPAIVLMPEVTVPKWGAVYIPSVITLLNAVGTPKSLHLM
PtCslA1  (369) HIVTFTFYCVVIPAIVLVPEVQVPKWGAVYIPSIITLLNAVSTPKSLHLL
CtManS   (365) HWVTFFFYCIVIPACVTVPEVNLKKQIALYIPATITILNAVSTPRSMHLL
PpCslA1  (363) HIVTFTFYCVVIPASVLVPEVDLFNGAVYVPSIITLLNAITTPKSLHLL
Consensus(401) HIVTF FYCVILP TVLVPEV VPKWSTVYIPSIITLLNAIATPRSLHLL 451                                                    500
AtCslA1  (296) IFWVLFENVMAMHRTKGTCIGLLEGGRVNEWVVTEKLGDALKSKILS---
AtCslA10 (446) IFWILFENVMSMHRTKGTFIGILERQRVNEWVVTEKLGDALKTKILP---
AtCslA11 (337) IFWVLFENVMAMHRTKGTFIGLLEGGRVNEWVVTEKLGDALETKILP---
AtCslA15 (435) IFWVLFENVMAMHRTKGTLIGIFEGGRVNEWVVTEKLGDTLNTKILP---
AtCslA14 (419) LYWILFENVMAMHRSIGTLIGLITSRVKEWIVTQKLGE--SNNIRE----
AtCslA3  (444) VFWILFENVMSMHRTKATFIGLLEAGRVNEWVVTEKLGDTLKSKIIG---
AtCslA7  (443) AFWVLFENAMSLLRAKALVMGIFITGRVQEWVVTEKLGDTLKTKIIP---
AtCslA2  (421) FYWILFENVMSLHRTKATLIGLIEAGRANEWVVTAKLGSCQSAKGN----
PoXylS   (421) FYWVLFENVMSFHRTKATIIGLLEAARVNEWVVTEKLGDALKNKSK----
AtCslA9  (421) VFWILFENVMSLHRTKATFIGLLEGGRVNEWIVTEKLGD-VKAKSA----
PtCslA1  (419) VFWILFENVMSLHRTKATEIGLLEAGRVNEWVVTEKLGDAMKHKSG----
CtManS   (415) VLWILFENVMSLHRTKAAIIGLLEANRVNEWVVTEKLGNAMKQR------
PpCslA1  (413) VFWILFENVMSLHRTKATIIGLFDIGNVNEWVVTEKLGNLMKYRSAKYGK
Consensus(451) VFWILFENVMSLHRTKATIIGLLEAGRVNEWVVTEKLGDALK KL 501                                                    550
AtCslA1  (343) ---------RVVQ-RKS-CYQRVNSKEVMVGVYILGCALVGLIY-GHTWLH
AtCslA10 (493) ---------RIGKPSNM-FLFRVNSKEIMVGIYILCCACVGLFI-GNTLLY
AtCslA11 (384) ---------QVRKPRNG-FLERINSKEMMVGIYILCCASVNLVF-GKTVLY
AtCslA15 (482) ---------QNGR-----LPKRVNLKEMMMGIYILCCACYDFAF-GNAFLY
AtCslA14 (464) ---------NLIFPDHYSFPERLRWREIMVGMYLFICGYYDFVF-CRTYLY
AtCslA3  (491) ---------KATTKLYTRFGQRLNWRELVVGLYIFFCGCYDFAY-GGSYFY
AtCslA7  (490) ---------QVPN---VRFRERVHLLELLVGAYLLFCCIYDIVY-GKNTLY
AtCslA2  (467) -----TKGIKRFPRIFKLPDRLNTLELGFAAFLFVCGCYDFVH-GKNNYF
```

Figure 6D

```
   PoXylS  (467) -----SAAPRRS-LTKILGDRIQLQELGFAVELFICGCFDYVY-GKNYYF
  AtCslA9  (466) -----TKTSKKV-IRFRFGDRIHVLELGVGMYLLFVGCYDAFF-GKNHYY
  PtCslA1  (465) ------KQIKKSR---SRIGERLHVLELFAGVYLFFCASYDLAF-GRNHFY
   CtManS  (459) -----NNARPSRASRFRIIERIHPLEIIVGMYMLHCATYDLLF-GHDHFF
  PpCslA1  (463) KYTLQRMASNMLARGWKMSERLHILELWTGGFLMFCAVYDFYFQCKNHFY
Consensus  (501)                 R  ERLN ELMVGIYLL CA YD VF GK HFY
                 551                          581
  AtCslA1  (382) FYLFLQATAFFVSGFGFVGT-------------
 AtCslA10  (533) LYLFMQAVAFLISGVGFVGT-------------
 AtCslA11  (424) IYLYMQALAFIIAGIGFIGT-------------
 AtCslA15  (518) LYLFMQATAFLISGVGFVGT-------------
 AtCslA14  (505) VYLFLQSIAFFVVGVGYVGMPVFSTPVQTSE
  AtCslA3  (532) VYLFLQSCAFFVAGVGYIGTFVFTV------
  AtCslA7  (528) VYLLFQSVAFFVVGFGFVGKYVFASSYLA--
  AtCslA2  (511) IYLFLQTMSFFISGLGWIGTYVPS-------
   PoXylS  (510) VYFWLQVVTFTIAGFGYIGTIVPSH------
  AtCslA9  (509) LYLFAQAIAFFIAGFGQIGTIVPNH------
  PtCslA1  (506) IYLYIQAAAFFVMGFGYIGTFVPTS------
   CtManS  (503) VYLLLQAGAFFTMGFGLVGTIVPT-------
  PpCslA1  (513) VYLFLQSCAFLIMGFGYVGTFVFHYS-----
Consensus  (551) VYLFLQAVAFFIAGFGFVGT VP
```

Figure 7

```
                      1182                                              1231
AtCslA2    (919)  
AtCslA9    (1175) ATGCAAGAAATGTCTTTGGATTATCATTTTACGGTGGAACAAGAAGTTGG
Consensus  (1182) ATGCAAGAAATGTC TTGGATTA CATTT AC GT GA CAAGAAGT GG
                      1232                                             1281
AtCslA2    (969)  
AtCslA9    (1225) TTCTTCTACTTACGCTTTCTTCGGATTCAATGGAACTGCGGGAATATGGA
Consensus  (1232) TTC TC AC  A GCTTT TTCGG TTCAA GGAAC GC GGAATATGGA
                      1282                                             1331
AtCslA2    (1019) 
AtCslA9    (1275) GAATATCGGCATTAAACGAAGCTGGTGGTTGGAAAGATAGAACGACCGTG
Consensus  (1282) GAATA CGGC  TAAA GAAGCTGGTGG TGGAAAGAT G AC ACCGTG
                      1332                                             1381
AtCslA2    (1069) 
AtCslA9    (1325) GAAGATATGGATTTGGCCGTGAGAGCTAGTCTCAAGGGTTGGAAATTCTT
Consensus  (1332) GAAGATATGGAT T GCCGT  GAGC AGTCT    GG TGGAAATT  T
                      1382                                             1431
AtCslA2    (1119) 
AtCslA9    (1375) GTACCTCGGTTCTTTGAAGGTTAAAAACGAGTTGCCAAGTACATTCAAGG
Consensus  (1382)  TACCTCGGT   T  AGGT AAAA  GAG T CCAAGTAC TT  A  G
                      1432                                             1481
AtCslA2    (1169) 
AtCslA9    (1425) CTTATAGGTATCAACAGCACAGGTGGTCATGTGGTCCAGCTAATCTTTTC
Consensus  (1432) C T   G T TCA CA CA AG TGGTC TGTGG CC GC AATCT TT
                      1482                                             1531
AtCslA2    (1219) 
AtCslA9    (1475) AGGAAAATGGCATTCGAAATCATGACTAATAAGAACGTGACTTTGTGGAA
Consensus  (1482) AGGAAAATGG   T GA ATC T A  AA AAGAA GTGA  TT TGGAA
                      1532                                             1581
AtCslA2    (1269) 
AtCslA9    (1525) GAAAGTTCATGTGATATATAGCTTCTTCGTGGTTAGAAAGCTAGTGGCAC
Consensus  (1532) GAAAGT  A GTGATATA AGCTTCTTC T GT AG AA   T  T GCAC
                      1582                                             1631
AtCslA2    (1319) 
AtCslA9    (1575) ACATTGTTACCTTCATCTTCTACTGTGT-GATCTTACCCGCTACAGTTCT
Consensus  (1582) A    GT AC TT   TTCTACTG GT G TCTT C C C ACA TTCT
                      1632                                             1681
AtCslA2    (1368) 
AtCslA9    (1624) TGTACCGGAAGTTACTGTTCCGAAATGGGGAGCGTTTTACATTCCTTCAG
Consensus  (1632)  GT CCGGA GTTA  GTTCCGA  TGGGG  CG TTTA AT CC TC
                      1682                                             1731
AtCslA2    (1418) 
AtCslA9    (1674) TCATTACTCCTCAACGCCGTTGGGACACCAAGGTCATTGCATCTTATG
Consensus  (1682) TCAT ACT TCCTCAA  CCGT GG AC CCAAGGTCA T CATCT  TG
                      1732                              1763
AtCslA2    (1468) 
AtCslA9    (1724) GTCTTTTGGATTCTGTTCGAGAATGTGATGTC
Consensus  (1732)  TCT TTGGATTCT TTCGAGAATGTGATGTC
```

Figure 12A
Maize CsIA DNA sequences:

```
>ZmCSLA1[PC0516604] COMPLETE
CCCACCCCCCTACCCCCGCGGCGCCGCCGGAGCCAGAGCGAGAGCGATGGACGCGCTGCCGGAGGCGTGGTCGCAGGTGCGCGCGCCGGTGATCG
TGCCGCTGCTGCGGCTGGCGGTGGCCGTGTGCCTCACCATGTCGGTGCTTCTGTTCCTTGAGCGCGTGTACATGGCCGTCGTCATCTCCGGGGTG
CGCCTGCTCCGCCTCCGCCCCGACCGCCGCTACCGCTGCGACCCCCTCCCCGGAGGACGACCCGGAGCTGGGCTCCTCCGCGTTCCCCGTCGTGCT
CGTCCAGATCCCCATGTTCAACGAGCGCGAGGTGTACCAGCTGTCCATCGGCGCCGTGTGCGGGCTGTCGTGGCCGGCGGACCGGCTGGTGGTGC
AGGTGCTCGACGACTCCACGGACGAAGTGATTAAGCAGGAGATGGTGCGGATGGAGTGCGAGCGGTGGGCTCGGAAGGGGATCAACATAACGTAC
CAGATCCGGGAGGACCGCAAGGGGTACAAGGCCGGCGGCGCTGCGGGCCGGGATGAGGCACGCGTACGTGCGCGACTGCGAGTACGTGGCCATCTT
CGACGCCGACTTCCAGCCCGACCCGGACTACCTCAAGCGCACCATCCCCTACCTCGTCCACAACCCGGAGATCGCCCTCGTCCAGGCGCGCTGGA
GATTCGTGAACGCGGACGAGTGCCTGATGACGAGGATGCAGGAGATGTCCCTGGACTACCACTTCACCGTGGAGCAGGAAGTGAGCTCCTCCGTC
TGCCGCCTTCTTTGGATTCAACGGCACCGCCGGCGTGTGGCGCATCTCCGGGTGAACGAGGCTGGGGGGTGGAAGGACCGGACCACGGTGGAGGA
CATGGATCTGGCCATCCGGGCCAGCCTCAAGGGCTGGAAGTTCGTCTACCTCGGTGACGTCCAGGTGAAAAGCGAGCTGCCGAGTACCTTCAAGG
CCTTCCCGGTTCCAGCAGCACAGGTGGTCGTGCGGCCCGAACCTGTTCAGGAAGATGCTCATGGAGATTGTGACGAACAAGAAAGTGACGATC
TGGAAGAAGATCCACGTCATCTACAACTTCTTCCTGATACGCAAGATCATCGCGCACATCATCACCTTCTCGTTCTACTGCGTCATCATCCCGGC
AACCATCTTCGTCCCCGAGGTCCGCATACCCAAGTGGGGCTGCGTCTACATCCCCTCGGCCATCACCCTCCTCAACTCTGTCGGCACTCCCAGGT
CTTTTCCACCTGCTTTTCTTCTGGGTCGCCTTCGAGAACGTCATGTCCCTGCACAGAACAAAGGCCACGCTGATCGGCTTGCTGGAGGCCGGCAGG
GCCAACGAGTGGGTGGTGACCGCGAAGCTCGGCAGCGCCATGAAGATGAAATCGGCTAACAAAGCGGGGCTCAGGAAGCAGTTCATGAGGATATG
GGAGAGGCTGCACGTCACGGAGCTCGGGGTGGCAGCCTTCCTCCTCCTGCGGCTGGTACGATCTTGCGTACGGGAGGGACCATTCTTCATCT
ACCTCTTCTTCCAGTCTGTCGCGTTTTTCATCGTCGGCGTCGGCTACGTCGGCACCATCGTCCCGCAGTCGTAGCGGAAGCGTGTCCAGATCATC
CCCTTCTCTCTCGGTTTTCCCATTCTGTCTTCGGTAAGTTTCCTACTGCATCACCCGTTTCACCTAAACATCATGCATCGCGTCCTCTCTTCCATC
GTCTTTTTTTGGGGACCGGCCGTGTGTGCTTCGTCGACCTTCGGCTGCATGCGCGGTGTTTTACTGTAAAATAGGAAAGCAGTGTTGCAAGATCG
CTGCAGGAGAATTTAGAGATTGGTGCCACATGGGCAGGAGATGTCCTGGTGTTTCTGCTTATATGCTATATCAACTATGTGATGTGTTTTAAGGG
GGGGTGCAGGATGGCTGCTTCCAATGTACTAGTAACATACAGAGAAACAGGTTCAGACATGTGTTCAGAAAAAAAA

>ZmCSLA2[PC0531087]start:2 stop:1619 COMPLETE
CATGGAGTTGGAGGGGCCGTGGGCGCGGGTGCTGCACCTGCACGATGCGTGCGAGTGGGGCCGGGCGGTGCGGGCGCGCGGTGGCGCCGGCGC
TGGAGGCCGCGGCGTGGGCGTGCCTCGCCATGTCGGTCATGCTGCTCGAGGTGTGCTACATGAGCGTCTCCAGCTTCGTCGCCGTCAACCCTG
CTGCGCCGGACCCCACAGCGGCGGTACAGCTGGGAGCCCATGCCCTCCGGGACCGCCCGGGGGACGATGAGGAGGCAGCGGTGGGCGATGGAGG
CGGCGAGGCGTACCCGATGGTACTCGTGCAGATCCCCATGTACAACGAGAGGAGGTCTACAAGATCTCTATTGGAGCGGCATGTGCCCTCACAT
CGCCCGCCCGACCGTATTATAATCCAAGTATTGGATCATTCCACCGACCCATTCATTAACGAACTTCTGCACTTTCAATGCCAAGCATTCCCCACC
AAGAAAATCAACATAAAATATGAAATTCGGGAAAGTAGGAAGGGATACAAAGCAGGAGCCCTGAAGAAGGGCATGGAACATAGTTACGCCCAAGA
ATGTCATTTTCTTCCCATCTTTCATCGCAGATTTTCAACCTCATCCCGACGTCCTTTTAAGAACTATACCATTTCTTCTGCATAACCCGAACATTC
CTCTAGTACAGACACGTTGGCAGTTTGTGAACTACAATATTTGCCTACTGACAAGGATACAGAAGATGTCACTAGATTATCATTTTAAGGTAGAG
CAGGAATCAGGGTCATCTGTCATGCCTTCTTTGGTTTCAACGGTACCGCTGGCGTGTGGCGGGTATCAGCTATCGGTGAAGCAGGAGGATGGAA
GGATCGCACCACTGTGGAAGACATGGACTTGGCTGTGCGGCAAGCCTCAAGGGATGGCAGTTCCTGTATGTTGGTGATATAAGGGTTAAGAGTG
AACTCCCAAGTACTTTCAAGGCCTACCGTCATCAACAGCACAGGTGGTCGCTTCTACCTCTTCAGGAAAATGGCCGGGGACATTGTT
ATAAGCAAGGGGGCGACTGTATGGAAGAAGCTTCACCTTCTGTACAGCTTCTTCTTCGTCCGAAGGGTCATCGCTCCCATCCTAACGTTCCTGTT
CTACTGCGTCGTGATCCCACTGTCTGTCATGGTCCCCGAAGTCAGCATCCCTGCCTGGGGAATGTTCTACATTCCCACTGCCATCACCATCATGA
CAGCCATCAGGAATCCTTGGTCTATCCATCTGGTGCCAATATGGATCCTGTTCGAGAACGTCATGTCCATGCACCGAATGCGCGCGGCGCTGACG
GGGCTGCTGGAGACCACGTACGTGGACGAGTGGGTGGTCACCGAGAAGGTGGGCGATCATGTGAAGGACAAGCTCGAGGTCCCTCTCCTTACACC
GGTGAAGCCAACCGAGTGCGTCGAGAGGATCTACTTGCCTGAGCTCCTGGTCCGCTTCTACCTGTTGCTATGCGCGTCGTACGATGTCGTGCTCG
CAGCCGCCGCCACTACTACCCGTACATCTTCCTCCAGCCCTTCCCTTCCTCCTGCTGCCGTTTGCCTTCCCCGGCACCGTGACGCCCTGCTCTTCT
TCATAAGCCATCGCGCGCATACGCTAGCGCCCATGGCTATTTGCTGCATTCTTC >ZmCSLA6[PC0590057] start:36 stop:1640 COMPLETE
GAGCAGTGCCTGAACCCAAGTGCAGTGCAGCAGCCATGGGAGCAGCAGCAGCAGGTGGCCACGCGCTGCGCGCCGTCGGCGACGTCGTCTCGTTC
CCCGCGACCGTCGCCGCCTTCGTGGAGGCGCTGCTCCAGGGCTGGGCCGAGGCCAGGGCCGGGCTGCTGGTGCCGCTGCTCCGCGCGCGGTGCT
CCTGTCCACGGCCATGTCGCTGATCGTCCTGGCCGAGAAGCTGTTCCTGGGCGCCCGTCAGCTCCCTGCCCAAGCTGCCGCCCCGCGTCCCGCGC
GGGTGTGCAGGTGCGACCCCGACGAGGAGGCGGCTGCCGGCATCCCAGGCCTATCCCATGGTGCTCGTCCAGATCCCCATGTACAACGAGAGGGAG
CTTTACCAGCTATCAATAGACCGACCTGCAGGCTCACATCCCGCCGTACATCGACTAATAGTCGCAGGTGCCTCGACCACTCCACCCGACTCCGTCAT
CAAGGAGCTGGTGAAGGGCGAGTGCGAGCGGTGGGCCACGGAGGAGGGGATCAACGTCAAGTACGAGACGCGCAAGGACAGGGCCGGGTACAAGG
CCCGCAACCTCAACCACGGGATCGCGCACGCCTACGTCGCCGCCTGCCAGTTCGTCCCCATCTTCCACCCAGACTTCCAGCCCGCCCCCGACTTC
CTCGTCAGAACCGTCCCGTTCCCCGTCCACAACCCCAGCCTCGCGCTCGTGCAGACACGCTGGAAGTTCGTGAATGCCAACGACTGCTTGCTGAC
CAGAATCCAGCAGATCTCCATCGCACTACCATTTCAAGCGCCACACGGAAGCTCGCTCTTCCTTATGCAACTTCTTTGCATACAACCCGAACCCCTG
GAGTATGGAGAACGCAAGCGATCGTCGAGTCCGGGGCTGGGAGGACCGAACCACTGCTGAGGACATGGACTTGGCGCTGAGAGCAGGCCTCCTG
GGCTGGGAGTTCGTCTACGTTGGAAGCATAAAGGTTAAGAGTGAGCTGCCGAGCACTCTCAAGGCGTACCGGTCCCAGCAGCACCGCTCGTCATG
CGGACCTGCCCTCCTGTTCAAGAAAATGTCTGGCAAATTCTCGCTGCCGAGAGAGTGCGGTCTGAAGAAGTGGTACATGGTCTATGACTTCT
TCATTGCCGGAGAATCGTAGGCACCTTCTACACGTCCTTCTTTTTCAGCGTCCTGATTCCTCTGAACATTCTGCTACCCGAAGCGCAGATTCCT
GTGTGGGAGCTCATCTATATCCCCATAGCTATCACTCTTCTCAACTCTGTTGGGACTCCCAGGCTATCCATCTGGTCATACTGTGGGTCTTGTT
CCACAACGTAATGCCCTTGCATCGCTTTAAAGCCATCTTCATAGGCTTTCTCCAAGCTCACAGGCCCAACCAATCCATCCTGACGCAAAAGCTCG
GGAATCTGCAGAAGCTGAAATCGATCGCCAGATTACAGGAAGCTACCGTTTCAAAGACAGGTTCCATTTCCTGGAGGTGTTCATTGGGCTGTTC
CTTTTTCCCCTCTGCCTGCCTTTCGACTACTTATACAGACATGACTATGTTTACCTCTTTGTTCTTCCCCAATCGATCATGTATTTCGCCATTCCCTT
TCAGTTCGTTGGTCTCAATGTCCTCTGAAGACTGACCAATTGCAAGACAACTGAACGTTTTGGTTGCGATACTATGATTGCTCGGGTCAAGGTTCT
TGT
```

```
>ZmCSLA8[PCO515480] start: stop:1719 C-TERMINAL
CCCGTGGTGCTGGTGCAGATCCCCATGTACAACGAGCGGGAGGTGTACAAGCTGTCGATCGGGGCGGCATGTGCGCTGGAGTGGCCGCCGGAGCG
CTTCGTGATCCAGGTGCTGGACGACTCCACGGACCCCGTTGACCTGGTGGAGACGGAGTGCCAGAGGTGGAAGAGCAAAGGCGTGAACATAAAGT
ACGAGGTGAGGGGGAACCGGAAGGGGTACAAGGCCGGCGCGCTCAAGGAAGGACTGAAGCACGACTACGTCGCAGACTGCCAATACATCGGCATG
TTCGACGCCGACTTCCAGCCTGACTCTGACTTCCTCCTCAGGACTATCCCGTTCCTCGTGCACAACCCGGAGATCGCCCTCGTCCAGGCTCGCTG
GAAGTTTGTTAATTCTGACGAGTGTCTGCTGACAAGATTCCAAGAGATGTCGTTGGACTACCATTTTCAAGTATGAGCAACAGGCCGGCTCCTCGG
TGTATTCATTCTTTGGCTTCAATGGGACAGCTGGTGTCTGGAGGATCTCAGCGATCGATGATGCTGGGGGCTGGAAGGACCGGACGACAGTGGAA
GATATGGACCTGGCTGTCCGTGCGATGCTGCAGGGATGGAAGTTCCTTTACGTCGGCGACATTAAGGTCAAGAGCGAACTGCCTAGCACATTCAA
GGCGTACCGGTTTCAGCAGCACAGGTGGTCATGTGGGCCGGCGAACCTGTTCAAGAAAATGATGGTAGAGATTTTACAAAACAAGAGAGTGTCGC
TGTGGAGTAAAATCCACCTATGGTACGATTTCTTCTTCGTCGGGAAAGTCGCTGCTCATACGGTGACATTCATCTACTACTGCTTCGCGATCCCT
GTGTCTGTTCTCTTCCCTGAGATCCAGATCCCTCTCTGGGGAGTTGTCTATGTCCCGACAGTCATAACCCTCTTGAAGGCTCTTGGCACACCGAG
TTCCTTTCACCTGGTGATCCTCTGGGTCCTGTTTGAGAATGTCATGTCGTTGCACCGGATTAAGGCTGCAGTAAGTGGTCTTCTGGATGCTGGTG
GGCGAGTCAATGAGTGGGTTGTCACTGAGAAGTTTGGGCGACACCAGCAAGGCAAAGCCTGGCACCAATGGATCAGACACTGCTGTAAAGGTGATA
GATGTGAAGCTAACAGAACCGCTTGTTCCGAAGCTAGTGAAGAGGCGAGCAAGATTTTTGGGAGAGGTACCACTGCTCAGAACTTTTCGTTGGAAC
CTGCATAATCCTGTGTGGTTTCTATGACCTGCTTTTTGCAAATAAGGGATACTACATTTTTCTCTTCCTTCAAGGCACGCGTTCCTTGTTGTTG
GTTTTGGGTATGTCGGCACACTACCTCCTTGCACTGCATAAGCTGTCATGGACAACTGATATTACCTGCTCACCAGAAACTGAGCAAGCAAAGCT
CCTCTCTCCTGCACATATCAAACTCTTGAATTCAATGATAGTTGAGCAATGTTCCCCCATCAGTCTTGGCCTGACATGATCCACCGCCGAGAAGG
TTGTTCAGATATCGCCGTCGTTCTCCTGTCAGTGTTGGTCAGATTTGAGCCAAACCATTCTTTATTGTCAGAAGGCCATTCAAATAGTGTCACCA
TTGCAAATTTTATAATAACCGTGTTTACCGAACGCATCATGAAAACAAAAATCATTGGTGCACCAGCATTTCGTTCGCATTCCATACACATGCACT
TCACATCCAGTATTTTTTTTGGAAATCTAGTGTTATTACTCAGAGTTCAGATCCATAATGGAAGATTGTTGGCTTCCTCAGTTCATAACCTGTG
TAGGCTTAAAACTTGTAGATGTAAATTGTTATTAACACTAATATTTTTTATTGAATCCGGGTATTATTGAAATGCAAGTGTAGCATGCATTTCTT
TTCCTGTAAGAAGCCAAAGATGACTTCTGAGTAACACGTCTAATCAGACATTTTACTTGATG >ZmCSLA3[PCO531088] start: stop:1231 C-TERMINAL
GATTTGGTGGAGACGGAATGCCAAAGATGGAAGAGCAAAGGCGTGAATATAAAGTACGAGGTGAGGGGGAACCGGAAGGGGTACAAGGCCGGCGC
GCTCAAGGAAGCACTGAAGCATGACTACGTCGAAGACTGCGAGTACATCGCCATGTTTCGATGCTGACTTCCAGCCCGAGCCTGATTTCCTCCTAA
GGGCTGTCCCATTCCTTGTGCATAACCCGGAGATCGCCCTCGTCCAAGCTCGCTGGAAATTCGTTAATTCTGGTGAGTGTCTGCTGACGAGATTC
CAAGAAATGTCCTTGGACTACCATTTCAAGTATGAGCAAGAGGCAGGCTCCTCACTGCATTCATTCTTTGGCTTCAATGGGACAGCCGGTGTCTG
GAGGATTGCAGCTATCGATGACGCCGGGGGCTGGAAGGACCGGACGACGGTGGAGGATATGGACCTGGCTGTCCGTGCGATGCTGCAGGGCTGGA
AGTTTGTTTACGTCGGCGACATAAAAGTCAAGAGTGAATTGCCTAGCACGTTCAAGGCATACCGGTTTCAGCAGCACAGGTGGTCTTGTGGACCG
GCAAACCTGTTCAAGAAAATGATGGTAGAGATTTTAGAAAACAAGAAAGTGTCATTGTGGAGCAAAATCTACTTATGGTACAATTTCTTCTTCGT
TGGGAAGGTCGCTGCCCACACGGTGACATTCATCTACTACTGCTGTGCGATCCCCGTGTCTGTTTTGCTTCCTGAGATTCAGATACCTCTCTGGG
GAGTTGTCTATATCCCGACGCTCATAACCCTCTTGAAGGCTCTTGGCACACCAAGTTCGTTTCACCTGGTGATCCTCTGGGTTCTGTTTGAGAAT
GTCATGTCACTGCACCGGATTAAAGCTGCAGCAAGTGGTCTTCTGGATGCTGGTGGACGAGTCAATGAGTGGGTTGTCACCGAGAAGTTGGGCCA
CACCAGCAAGCCAAAGCCTGGCGCCAATGGATCAGATGATGTAAAGGTGATAGATGTAAAGCTAACAGAACCCCTCGTTCCCAAGCTAGTGAAGA
GGCGAGCAAGATTTTGGGAGAGGTACAACTGCTCAGAACTTTTCGTTGGAACCTGCATACTTCTGTGTGGTTTCTATGACTTGCTTTTTGCAAAG
AAGGGATACTACATTTTTCTCTTCCTTCAAGGCACGGCTTTCCTTGTTGTTGGCTTTGGGTATGTCGGCACACTACCTCATTGCAATGCATAAGC
TGGCATGGACAATTCATATACCTTCTTACTAGAAACAGATCAAGCAAAGTTCCTCTCTCCTGCCCATATGGAACTTCAATGATAGTTGAGCAATA
TTCCCATGATCACTCTTGCCCACACATCATTCACTGCCAACAAGCTTCTTCACATGTCCTCCTCACTCTTCTGTCACTCTTTATTGTCAACAACC
CCATTCAAATAGTGTCACCGTTCCAAATTTATAATAACAGTGTTTACTGAAGCATCATGACATACAAGAATGATTCGTGCAGCAGCATTTAGTAA
ACATCCCGTAGAGATGCAGTTCACAGTCGTGAAAGAACTGCAGCTGCTGTAAATGGAATAGCACCAGTTGCCAATTTCTGTAGATCTCCGAACTT
TTTTTTGGAAATTTTGTGATATTACTCAGAGTTCAGATCAATAATGGAAGATTGTTGGCTTCCTCAGTTCATAACCTGTGTATGCTTAAAACTTG
TAAATGTAAATTGTTATTGACACTAATAATTTTGTCGAACCCAGGCAGTTCTTGAAATGCAAATGTAGCATGCAAATTTTTTTTT
```

Figure 13

Maize CslA predicted proten sequences:

>ZmCSLA1 predicted protein (515 AA)
MDALPEAWSQVRAPVIVPLLRLAVAVCLTMSVLLFLERVYMAVVISGVRLLRLRPDRRYRCDPLPEDDPELGSSAFPVVLVQIPMFNEREVYQLS
IGAVCGLSWPADRLVVQVLDDSTDEVIKQEMVRMECERWARKGINITYQIREDRKGYKAGALRAGMRHAYVRDCEYVAIFDADFQPDPDYLKRTI
PYLVHNPEIALVQARWRFVNADECLMTRMQEMSLDYHFTVEQEVSSSVCAFFGFNGTAGVWRISAVNEAGGWKDRTTVEDMDLAIRASLKGWKFV
YLGDVQVKSELPSTFKAFRFQQHRWSCGPANLFRKMLMEIVTNKKVTIWKKIHVIYNFFLIRKIIAHIITFSFYCVIIPATIFVPEVRIPKWGCV
YIPSAITLLNSVGTPRSFHLLFFWVAFENVMSLHRTKATLIGLLEAGRANEWVVTAKLGSAMKMKSANKAGLRKQFMRIWERLHVTELGVAAFLF
SCGWYDLAYGRDHFFIYLFFQSVAFFIVGVGYVGTIVPQS >ZmCSLA2 predicted protein (539 AA)
MELEGPWARVLHLHDACEWGRAVRARAVAPALEAAAWACLAMSVMLVLEVCYMSVSSFVAVNLLRRTPQRRYSWEPMPSGTARGDDEEAAVGDGG
GEAYPMVLVQIPMYNEREVYKISIGAACALTWPPDRIIIQVLDDSTDPFIKELVEFECKDWASKKINIKYEIRESRKGYKAGALKKGMEHSYAQE
CDFVAIFDADFQPDPDVLLRTIPFLVHNPKIALVQTRWEFVNYNICLLTRIQKMSLDYHFKVEQESGSSVHAFFGFNGTAGVWRVSAIGEAGGWK
DRTTVEDMDLAVRASLKGWQFLYVGDIRVKSELPSTFKAYRHQQHRWTCGAANLFRKMAGDIVISKGATVWKKLHLLYSFFFVRRVIAPILTFLF
YCVVIPLSVMVPEVSIPAWGMFYIPTAITIMTAIRNPWSIHLVPIWILFENVMSMHRMRAALTGLLETTYVDEWVVTEKVGDHVKDKLEVPLLTP
VKPTECVERIYLPELLVAFYLLLCASYDVVLGAGHYYPYIFLQAFAFLVLGFGFAGTVTPCSCS >ZmCSLA6 predicted protein (537 AA)
MGAAAAGGHALRAVGDVVSFPATVAAFVEALLQGWAEARAGLLVPLLRAAVLLCTAMSLIVLAEKVFLGAVSSVAKLRRRRPGRVCRCDPDEEAA
AASQAYPMVLVQIPMYNEREVYQLSIEAACRLTWPVDRLIVQVLDDSTDSVIKELVKGECERWATEEGINVKYETRKDRAGYKAGNLKEGMRHAY
VRACEFVAMFDADFQPPPDFLVRTVPFLVHNPSLALVQTRWKFVNANDCLLTRMQEMSMDYHFKVEQEAGSSLCNFFGYNGTAGVWRTQAIVESG
GWEDRTTAEDMDLALRAGLLGWEFVYVGSIKVKSELPSTLKAYRSQQHRWSCGPALLFKKMFWQILAAERVSVWKKWYMVYDFFIARRIVGTFYT
FFFFSVLIPLNILLPEAQIPVWELIYIPIAITLLNSVGTPRSIHLVILWVLFENVMALHRFKAILIGFLEADRANEWIVTQKLGNLQKLKSIARL
TGSYRFKDRFHFLEVFIGLFLLASACFDYLYRDDYVYLFVLPQSIMYFAIGFQFVGLNVSED >ZmCSLA7 predicted protein (572 AA)
MEAGEIGGALVFILAAAAAVAAAVSVGAVDFSRPLTAGAPFDFQAAVSWLIGILDGTSSAAADVDGAWVAVRAGVIAPVLQVAVWACMVMSVMLV
VEAVYNSVISLGVKAIGWRPEWRFKWKPLDSADEEKGTAHFPMVLVQIPMYNELEVYKLSIAAACELQWPKDRIVIQVLDDSTDPFIKNLVELEC
EHWVNKGVNIKYATRTSRKGFKAGALKKGMECDYAWQSEYIAIFDADFQPEPDFLLQTVPFLLHNPEVALVQARWSFVNDTTSLLTRVQKMFYDY
HFKVEQEAGSATFAFFSFNGTAGVWRTGAIRDAGGWKDRTTVEDMDLAVRATLKGWKFVYVGDVRVKSELPSTYKACRQQFRWSSGGANLFRKMA
KDVLFAKDISLVKKFYMLYSFFFVRRVVAPTAACILYNVIIPISVTIPELYLPVWGVAYIPMVLTVVTAIRHPKNLHILPFWILFESVMTLHRMR
AAMTGLLELEGFNQWIVTKKVGNDLEDTEVPLLQKTRKRLRDRVNLPEIGFSVFLFLCASYNLVFHGKTSYYLYMYLQGLAFLLLGFNFTGNCSC
YQ >ZmCSLA9 predicted protein (526 AA)
MAVLAELGTVPAAGYSRSDVAAALWQQLKSPVVVPLLRVSVALCLAMSAMLFAEKVYMAVVVAASRLLGRRPERRYRWQPIRDGDDLEAAAAYPM
VLVQIPMFNEREVYKVSIGAACGLSWPSDRIIVQVLDDSTDPVVKELVRAECWRWASKGVNVKYEVRDSRRGYKAGALREGMKRAYARGCDLVAI
FDADFQPEPDFLWRAVPFLLHNPDLALVQARWKFVNADECLMTRMQEMSLDYHFAVEQEVGSSTYAFFGFNGTAGVWRISALNEAGGWKDRTTVE
DMDLAVRASLKGWKFVYIGDLMVKSELPSTLKAYRYQQHRWSCGPANLFRKTLVEIVRNKKVTLWKKIHVIYNFFLVRKIVAHAVTFVFYCIVIP
TTVLVPEVQVPKWGSVYIPTVITLLSAVATPRSAHLVVFWTLFENVMSLHRTKATFIGLLEAGRVNEWVVTEKLGDALRTKVPGKKPRMRIGDRL
HVLELGVAAYLLFCGCYDIAFGNNRYYIFLFLQSIAFFIVGIGYVGTFVPH >ZmCSLA4 pco567539+pco580659 predicted Protein (230 aa missing at N-terminal)
NADECILTRIQEMSLNYHFAVEQEVGSACHAFFGFNGTAGVWRVAALADAGGWKERTTVEDMDLAVRASLRGWRFVYVGDLVVRNELPSTFKAYR
YQQHRWSCGPANLFRKVLPEILRSDRVSLGKKFHLLYAFFFVRKVVAHLVTFLFYCVVIPACVLVQGDVRLPKYVAMYVPALITLLNAACTPRSC
HLLIFWILFENVMSMHRSKAAIIGLLEASRANEWVVTDKLGSSKAAAAVVAKKKKQQLVRSRCCSTRREMHVLELAMGVCLLYCAVYDIVFFGRD
HYYMYLLLQSAAAFIVGFGYVGTTTPS >ZmCSLA8 [PCO515480] predicted Protein (118 aa missing at N-terminal)
PVVLVQIPMYNEREVYKLSIGAACALEWPPERFVIQVLDDSTDPVDLVETECQRWKSKGVNIKYEVRGNRKGYKAGALKEGLKHDYVADCEYIAM
FDADFQPDSDFLLRTIPFLVHNPEIALVQARWKFVNSDECLLTRFQEMSLDYHFKYEQEAGSSVYSFFGFNGTAGVWRISAIDDAGGWKDRTTVE
DMDLAVRAMLQGWKFLYVGDIKVKSELPSTFKAYRFQQHRWSCGPANLFKKMMVEILENKRVSLWSKIHLWYDFFFVGKVAAHTVTFIYYCFAIP
VSVLFPEIQIPLWGVVYVPTVITLLKALGTPSSFHLVILWVLFENVMSLHRIKAAVSGLLDAGGRVNEWVVTEKLGDTSKAKPGTNGSDTAVKVI
DVKLTEPLVPKLVKRRARFWERYHCSELFVGTCIILCGFYDLLFANKGYYIFLFLQGTAFLVVGFGYVGTLPPCTA >ZmCSLA3[PCO531088] Predicted Protein(165 aa missing at N-terminal)
DLVETECQRWKSKGVNIKYEVRGNRKGYKAGALKEGLKHDYVEDCEYIAMFDADFQPEPDFLLRAVPFLVHNPEIALVQARWKFVNSGECLLTRF
QEMSLDYHFKYEQEAGSSLHSFFGFNGTAGVWRIAAIDDAGGWKDRTTVEDMDLAVRAMLQGWKFVYVGDIKVKSELPSTFKAYRFQQHRWSCGP
ANLFKKMMVEILENKKVSLWSKIYLWYNFFFVGKVAAHTVTFIYYCCAIPVSVLLPETQIPLWGVVYIPTLITLLKALGTPSSFHLVILWVLFEN
VMSLHRIKAAASGLLDAGGRVNEWVVTEKLGDTSKAKPGANGSDDVKVIDVKLTEPLVPKLVKRRARFWERYNCSELFVGTCILLCGFYDLLFAK
KGYYIFLFLQGTAFLVVGFGYVGTLPHCNA Figure 14
Psyllium DNA sequences:

>Psyllium_XylS_NT_full
CCATTACTCACTAGCTACTACTAGCTCCACTCCCGGCCCTTTCTCTCTCTCTCTACTCTCTCTCTCTTCT
GCTCCGCAATGCCGCAGTACTTCTCCATCCTTGTATAATCATCGGATTGAGCATTACTCGGCTTAATAAG
GGTAGCAGAAATCAAGAGAGAGATTAAAGAAGACCTTTAAGAAATAAAACAAAAAAAAAATTAAATAATT
TCTCATTACCATCCTCAGATCCAATGGCTGAGGTTTCCGGTAAGAGTTTCCTCCCTGAATCTCTACCGGG
ATACAACCCTGACATTACCGGCCAAATCGGTCTCCTATGGGAGCTCATCAAGACGCCGTTGATTATCCCT
GTCTTGAGGCTGTCTGTGTACATTTGCTTGGCAATGTCGATAATGGTGTTCATGGAGAGGCTTTATATGG
GTGTTGTTATTGTTCTCGTGAGATTGTTCTGGAAGAAGCCTGAGCAGCGCTACAAATGGGAGCCTATGGA
GGACGACATTGAGGATGCTAATGCTGCTTATCCCATCGTCCTCGTTCAGATCCCCATGTTCAACGAGCGA
GAGGTCTACAAGATCTCAATTGGTGCGGCGTGTAATCTTTCATGGCCTGCTGATAGGCTGGTGATTCAAG
TACTGGATGATTCCACTGATTTCACAATCAAGGACTTGGTTGAGAAAGAATGCCTTAGGTGGGCTAGCAA
AGGTATTAACATTCGGTACCAAATTAGAGAATCGCGAGGCGGATACAAAGCCGGTGCACTCAAAGAAGGG
TTGAAGCACGAATATGTCAAACGTGTGAATACGTAGTCATCTTTGACGCTGACTTCCGCCCGGAACCCG
ATTTTCTCAAACGTGCCGTCCCGTTTCTAATCCACAACAAGGACATTGCCCTCGTTCAGTCCCGATGGAG
ATTCGTGAATTCAGACGAGTGCTTGTTGACAAGAATGCAAGAAATGTCACTGGACTACCATTTCACTGTT
GAGCAAGAAGTTGGATCAGCAACGCATGCCTTTTTTGGTTTCAATGGAACTGGTGGTATCTGGAGAATTA
AAGCCATTAATGAAGCTGGTGGATGGAAGGACAGAACCACGGTAGAGGATATGGATCTTGCTGTTCGTGC
TGGTCTGAAAGGCTGGAAATTTCTTTACTTGGGAGACCTTCATGTGAAAAGTGAACTTCCTAGTACTTTC
AAGGCCTTCCGTTTCCAGCAGCACAGGTGGTCATGTGGTCCTGCTAATTTGTTCAGGAAGATGGTGTTTG
ATATTGCTACAAACAAGAAAGTCACATTGTACAAGAAGTTTTACGTGATCTACAGCTTCTTCTTTGTCCG
AAAGATCATTGCCCACATGTTCACCTTCTTCTTTTACTGTGTGGTTCTTCCCTTGACATGCCTTGTTCCT
GAGGTAGAGGTGCCAAAGTGGGGAGCCATTTATCTTCCTTGCATTATCACCGTCCTTAACTCAGTCGGAA
CTCCAAGGTCATTCCATCTGTTGTTCTATTGGGTTTTATTCGAGAACGTCATGTCTTTCCACCGCACCAA
GGCCACAATCATCGGTCTGCTAGAAGCTGCAAGAGTTAATGAATGGTTGTCACTGAAAAGCTTGGAGAC
GCTCTCAAGAACAAATCCAAATCAGCTGCACCAAGGAGATCATTGACCAAAATACTAGGAGACAGAATTC
AATTACAAGAGTTGGGATTTGCAGTATTTCTTTTCATCTGTGGATGTTTCGACTATGTATACGGAAAGAA
CTACTACTTCGTATACTTTTGGCTCCAAGTTGTCACCTTTACAATTGCGGATTTGGCTACATTGGCACA
ATAGTCCCAAGCCATTAAACAGCAGCAGTAGGAAGGAGTCACGCGTGGGAAAAGTACCAAGTACAACTCA
AATTCCTGTATTTTTAGCCTTATACAACATATGTACACAAGATTGATATGTCCGATGCTTCTGGTCAATT
ATTCCTTAGCCGGAAAACAAAAA

Figure 15

Psyllium Predicted protein sequences:

```
>PoXylS
MAEVSGKSFLPESLPGYNPDITGQIGLLWELIKTPLIIPVLRLSVYICLAMSIMVFMERLYMGVVIVLVR
LFWKKPEQRYKWEPMEDDIEDANAAYPIVLVQIPMFNEREVYKISIGAACNLSWPADRLVIQVLDDSTDF
TIKDLVEKECLRWASKGINIRYQIRESRGGYKAGALKEGLKHEYVKPCEYVVIFDADFRPEPDFLKRAVP
FLIHNKDIALVQSRWRFVNSDECLLTRMQEMSLDYHFTVEQEVGSATHAFFGFNGTGGIWRIKAINEAGG
WKDRTTVEDMDLAVRAGLKGWKFLYLGDLHVKSELPSTFKAFRFQQHRWSCGPANLFRKMVFDIATNKKV
TLYKKFYVIYSFFFVRKIIAHMFTFFFYCVVLPLTCLVPEVEVPKWGAIYLPCIITVLNSVGTPRSFHLL
FYWVLFENVMSFHRTKATIIGLLEAARVNEWVVTEKLGDALKNKSKSAAPRRSLTKILGDRIQLQELGFA
VFLFICGCFDYVYGKNYYFVYFWLQVVTFTIAGFGYIGTIVPSH
```

MODULATION OF PLANT XYLAN SYNTHASES

FIELD OF THE INVENTION

The present invention relates to polysaccharide production in plants through alteration of the polysaccharide synthesis pathways, particularly arabinoxylan.

BACKGROUND OF THE INVENTION

Plant cell wall consists mainly of cellulose microfibrils embedded in a matrix of hemicellulose, pectin, and, in mature cells, lignin (Bacic et al. 1988). In addition, small amounts of enzymatic and structural proteins are present. In cereal grains, the hemicellulosic fraction of the cell wall consists mainly of arabinoxylan (AX). For example, a corn kernel consists of approximately 8% cell wall, ~60% of which is AX. Arabinoxylan consists of a β-1,4-linked backbone of xylosyl residues that are substituted at varying intervals with arabino-furanosyl residues mainly through an α-(1→3) linkage. Glucuronosyl residues and acetyl groups further decorate AX at varying degrees, with the former attached mainly through and alpha-1,2-linkage and the latter with an O-2 or O-3 linkage (Dhugga 2007).

Arabinoxylan is known to be an antinutritional constituent of the corn grain feed targeted for monogastric animals, i.e., poultry and swine. Not only is it not digested, it is also known to reduce the rate of digestibility of other feed components, mainly because of its effect on the viscosity of the chime (Pettersson et al. 1990; Veldman and Vahl 1994). Aside from adversely affecting digestibility, arabinoxylan is the cause of sticky droppings and gummy excreta in monogastric animals. It is desirable, thus, to reduce the concentration of arabinoxylan in cereal cell wall, which will make it more suitable for feed applications.

Arabinoxylan is also a major component of corn stover, cereal straws, and switch grass (Carpita 1996). Because arabinose and xylose are five carbon sugars, currently used yeast fermentation procedure is not optimized to convert them into ethanol. Acetyl residues on AX are known to be inhibitory to the process of fermentation (Dhugga 2007). Corn accounts for nearly half of all the crop residue produced in the United States and will be a major source of cellulosic biomass when the process of ethanol production from the latter is streamlined (Dhugga 2007). A reduction in arabinoxylan and its substitution by cellulose in corn stover, cereal straws, and switch grass will be beneficial for ethanol production from these sources.

However, dietary fiber, particularly arabinoxylan, reduces cholesterol and low density lipoprotein levels in humans (WO 99/67,404). In breadmaking, bread quality depends heavily on the consistency of the dough. Dough that lacks viscosity alters the crumb structure of the bread and decreases the volume of bread produced. Arabinoxylan provides the viscous properties of dough (Girhammar et al. (1995) *Food Hydrocolloids* 9:133-140). Additionally, industries use isolated arabinoxylan preparations as thickeners, emulsifiers, or stabilizers in food, cosmetics, and pharmaceuticals. Therefore, in certain circumstances, it would be desirable to increase the concentration of arabinoxylans in plant.

Clearly, modulating the concentrations of polysaccharides, particularly arabinoxylan in various crops is a desirable goal. However, a direct approach using the enzymes that synthesize these polysaccharides has been hampered because of the difficulty in isolating and cloning the plant polysaccharide synthase genes. Polysaccharide synthase enzymes for the common polysaccharides are estimated to number in the hundreds. However, availability of the complete genome sequences of *Arabidopsis* and rice has made it possible to isolate the members of the cellulose synthase super gene family (Richmond and Somerville 2000; Hazen et al. 2002), which was accomplished through searching for homologous genes to a cellulose synthase gene that had previously been isolated from cotton (Pear et al. 1996). Proof for the involvement of any of these genes in β-glycan formation was obtained when a cellulose synthase-like (Csl) gene from guar that made β-mannan was functionally expressed in a heterologous system (Dhugga et al. 2004; Liepman et al. 2005).

An alternative approach was used by Burton et al. (2006) to identify mixed-linked glucan (MLG) synthase genes whereby they expressed the barley CslF sequences in *Arabidopsis* (Burton et al. 2006). MLG does not occur naturally in *Arabidopsis* walls. Detection of MLG by immunocytochemistry using antibodies specific to MLG in the walls of CslF-expressing *Arabidopsis* cells indicated the involvement of these sequences in MLG formation (Burton et al. 2006). Genes that encode xylan synthase, the enzyme that catalyzes the formation of the backbone of AX, remain unknown thus far. Compositions and methodologies useful in the modulation of arabinoxylan levels in plants are needed.

SUMMARY OF THE INVENTION

According to the invention, Applicants have identified the xylan synthase class of genes, through the use of genomics, phylogenetic analysis, and molecular biology. Applicants have established that the cellulose synthase-like (Csl) superfamily of genes, particularly, the CslA subfamily, which is localized in the Golgi, surprisingly act as xylan synthases and can be modulated for alteration of XA levels in plants. Applicants have further isolated a novel gene from Psyllium that acts as a xylan synthase.

This invention involves the identification of genes involved in the xylan synthesis pathway and the modulation of the same for improving bioavailability of feed, cereal composition and industrial uses of cereal plants.

In particular, the present invention provides nucleotide sequences, some or which are novel, but all of which have not previously been identified as xylose synthases. Therefore, in one aspect, the present invention relates to an isolated nucleic acid comprising an isolated polynucleotide sequence encoding a xylan synthase in psyllium. In another embodiment, the invention includes the discovery of an entire family of genes that have xylan synthase activity. One embodiment of the invention is an isolated polynucleotide comprising a nucleotide sequence selected from the group consisting of: SEQ ID NO: 1; (b) the nucleotide sequence encoding an amino acid sequence comprising SEQ ID NO: 2 (c) a polynucleotide having a specified sequence identity to a polynucleotide encoding a polypeptide of the present invention; (d) a polynucleotide which is complementary to the polynucleotide of (a); and, (e) a polynucleotide comprising a specified number of contiguous nucleotides from a polynucleotide of (a) or (b). The isolated nucleic acid can be DNA.

Compositions of the invention include an isolated polypeptide comprising an amino acid sequence selected from the group consisting of: (a) the amino acid sequence comprising SEQ ID NO:2 and (b) the amino acid sequence comprising a specified sequence identity to SEQ ID NO:2, wherein said polypeptide has xylan synthase activity.

The foregoing can also be applied to any cellulose synthase-like group A composition to identify other xylose synthases according to the invention. Applicants have also identified several known CslA sequences from maize that will be useful for the invention as xylan synthases. These include sequences for CslA1, CslA2, CslA3, CslA4, CslA6, CslA7, CslA8, CslA9 (nucleotide sequences SEQ ID NOS: 3, 5, 7, 9, 11, 13, 15, and 17 and corresponding amino acid sequences SEQ ID NOS:4, 6, 8, 10, 12, 14, 16, 18). From these sequence Applicants have identified several conserved residues which are indicated by highlighting in the figures.

Further compositions of the invention include expression cassettes and vectors for expression of these sequences in plants. Transformed plant cells, plants, plant tissues, and seed are also provided.

The invention further provides a method for modulation of xylose, or XA, in cereal plants. The method comprises stably incorporating into the genome of a plant a nucleotide sequence encoding a CslA polypeptide operably linked to a promoter that drives expression of the sequence in the plant. Preferred plants include but are not limited to maize, soybean, sunflower, sorghum, canola, wheat, alfalfa, cotton, rice, barley, tomato, and millet. Prairie grasses such as switch grass are also plants useful for the invention, particularly in ethanol production. Modification of plant xylan levels alters the digestability and nutritive value of the plant and improves the sanitation of livestock and poultry that have consumed the plant as well as improved industrial applicability for ethanol production and the like. Additionally, modification of plant xylan content allows for more efficient extraction of gums.

Another embodiment of the invention includes plants that have been genetically modified at a genomic locus, wherein the genomic locus encodes an CslA (xylan synthase) polypeptide of the invention.

Methods for increasing the activity of xylan synthase polypeptides in a plant are provided. Methods for reducing or eliminating the level of xylan synthase polypeptide in the plant are also provided. The level or activity of the polypeptide could also be modulated in specific tissues, such as the seed.

In a further aspect, the present invention relates to a polynucleotide amplified from a *Zea mays* nucleic acid library using primers which selectively hybridize, under stringent hybridization conditions, to loci within polynucleotides of the present invention to identify other xylan synthase, CslA proteins having xylan synthase activity which may be useful for the invention.

Also included are methods for identifying other xylan synthase enzymes for use in the invention comprising identifying enzymes which are classified as CslA enzymes as described and exemplified herein which surprisingly have been found to act as xylan synthases.

DEFINITIONS

Units, prefixes, and symbols may be denoted in their SI accepted form. Unless otherwise indicated, nucleic acids are written left to right in 5' to 3' orientation; amino acid sequences are written left to right in amino to carboxy orientation, respectively. Numeric ranges recited within the specification are inclusive of the numbers defining the range and include each integer within the defined range. Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes. Unless otherwise provided for, software, electrical, and electronics terms as used herein are as defined in The New IEEE Standard Dictionary of Electrical and Electronics Terms (5th edition, 1993). The terms defined below are more fully defined by reference to the specification as a whole.

By "amplified" is meant the construction of multiple copies of a nucleic acid sequence or multiple copies complementary to the nucleic acid sequence using at least one of the nucleic acid sequences as a template. Amplification systems include the polymerase chain reaction (PCR) system, ligase chain reaction (LCR) system, nucleic acid sequence based amplification (NASBA, Cangene, Mississauga, Ontario), Q-Beta Replicase systems, transcription-based amplification system (TAS), and strand displacement amplification (SDA). See, e.g., Diagnostic Molecular Microbiology: Principles and Applications, D. H. Persing et al., Ed., American Society for Microbiology, Washington, D.C. (1993). The product of amplification is termed an amplicon.

The term "antibody" includes reference to antigen binding forms of antibodies (e.g., Faba, F (ab) 2). The term "antibody" frequently refers to a polypeptide substantially encoded by an immunoglobulin gene or immunoglobulin genes, or fragments thereof which specifically bind and recognize an analyte (antigen). However, while various antibody fragments can be defined in terms of the digestion of an intact antibody, one of skill will appreciate that such fragments may be synthesized de novo either chemically or by utilizing recombinant DNA methodology. Thus, the term antibody, as used herein, also includes antibody fragments such as single chain FV, chimeric antibodies (i.e., comprising constant and variable regions from different species), humanized antibodies (i.e., comprising a complementarity determining region (CDR) from a non-human source) and heteroconjugate antibodies (e.g., bispecific antibodies).

The term "antigen" includes reference to a substance to which an antibody can be generated and/or to which the antibody is specifically immunoreactive. The specific immunoreactive sites within the antigen are known as epitopes or antigenic determinants. These epitopes can be a linear array of monomers in a polymeric composition-such as amino acids in a protein—or consist of or comprise a more complex secondary or tertiary structure. Those of skill will recognize that all immunogens (i.e., substances capable of eliciting an immune response) are antigens; however some antigens, such as haptens, are not immunogens but may be made immunogenic by coupling to a carrier molecule. An antibody immunologically reactive with a particular antigen can be generated in vivo or by recombinant methods such as selection of libraries of recombinant antibodies in phage or similar vectors. See, e.g., Huse et al., Science 246: 1275-1281 (1989); and Ward, et al., Nature 341: 544-546 (1989); and Vaughan et al., Nature Biotech. 14: 309-314 (1996).

As used herein, "antisense orientation" includes reference to a duplex polynucleotide sequence that is operably linked to a promoter in an orientation where the antisense strand is transcribed. The antisense strand is sufficiently complementary to an endogenous transcription product such that translation of the endogenous transcription product is often inhibited.

The term "conservatively modified variants" applies to both amino acid and nucleic acid sequences. With respect to particular nucleic acid sequences, conservatively modified variants refers to those nucleic acids which encode identical or conservatively modified variants of the amino acid sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations" and represent one species of conservatively modified variation. Every nucleic acid sequence herein that encodes a polypeptide also, by reference to the genetic code, describes every possible silent variation of the nucleic acid.

One of ordinary skill will recognize that each codon in a nucleic acid (except AUG, which is ordinarily the only codon for methionine; and UGG, which is ordinarily the only codon for tryptophan) can be modified to yield a functionally identical molecule. Accordingly, each silent variation of a nucleic acid which encodes a polypeptide of the present invention is implicit in each described polypeptide sequence and is within the scope of the present invention.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Thus, any number of amino acid residues selected from the group of integers consisting of from 1 to 15 can be so altered. Thus, for example, 1, 2, 3, 4, 5, 7, or 10 alterations can be made.

Conservatively modified variants typically provide similar biological activity as the unmodified polypeptide sequence from which they are derived. For example, substrate specificity, enzyme activity, or ligand/receptor binding is generally at least 30%, 40%, 50%, 60%, 70%, 80%, or 90% of the native protein for its native substrate. Conservative substitution tables providing functionally similar amino acids are well known in the art.

The following six groups each contain amino acids that are conservative substitutions for one another:
1) Alanine (A), Serine (S), Threonine (T); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); and 6) Phenylalanine (F), Tyrosine (Y), Tryptophan (W). See also, Creighton (1984) Proteins W. H. Freeman and Company.

By "encoding" or "encoded", with respect to a specified nucleic acid, is meant comprising the information for translation into the specified protein. A nucleic acid encoding a protein may comprise intervening sequences (e.g., introns) within translated regions of the nucleic acid, or may lack such intervening non-translated sequences (e.g., as in cDNA). The information by which a protein is encoded is specified by the use of codons. Typically, the amino acid sequence is encoded by the nucleic acid using the "universal" genetic code. However, variants of the universal code, such as are present in some plant, animal, and fungal mitochondria, the bacterium *Mycoplasma capricolum*, or the ciliate Macronucleus, may be used when the nucleic acid is expressed therein. When the nucleic acid is prepared or altered synthetically, advantage can be taken of known codon preferences of the intended host where the nucleic acid is to be expressed.

For example, although nucleic acid sequences of the present invention may be expressed in both monocotyledonous and dicotyledonous plant species, sequences can be modified to account for the specific codon preferences and GC content preferences of monocotyledons or dicotyledons as these preferences have been shown to differ (Murray et al. Nucl. Acids Res. 17: 477-498 (1989)). Thus, the maize preferred codon for a particular amino acid may be derived from known gene sequences from maize. Maize codon usage for 28 genes from maize plants is listed in Table 4 of Murray et al., supra.

As used herein "full-length sequence" in reference to a specified polynucleotide or its encoded protein means having the entire amino acid sequence of, a native (nonsynthetic), endogenous, biologically active form of the specified protein. Methods to determine whether a sequence is full-length are well known in the art including such exemplary techniques as northern or western blots, primer extension, S 1 protection, and ribonuclease protection. See, e.g., Plant Molecular Biology: A Laboratory Manual, Clark, Ed., Springer-Verlag, Berlin (1997). Comparison to known full-length homologous (orthologous and/or paralogous) sequences can also be used to identify full-length sequences of the present invention. Additionally, consensus sequences typically present at the 5' and 3' untranslated regions of mRNA aid in the identification of a polynucleotide as full-length. For example, the consensus sequence ANNNNAUGG, where the underlined codon represents the N-terminal methionine, aids in determining whether the polynucleotide has a complete 5' end. Consensus sequences at the 3' end, such as polyadenylation sequences, aid in determining whether the polynucleotide has a complete 3' end.

As used herein, "heterologous" in reference to a nucleic acid is a nucleic acid that originates from a foreign species, or, if from the same species, is substantially modified from its native form in composition and/or genomic locus by deliberate human intervention. For example, a promoter operably linked to a heterologous structural gene is from a species different from that from which the structural gene was derived, or, if from the same species, one or both are substantially modified from their original form. A heterologous protein may originate from a foreign species or, if from the same species, is substantially modified from its original form by deliberate human intervention.

By "host cell" is meant a cell which contains a vector and supports the replication and/or expression of the vector. Host cells may be prokaryotic cells such as *E. coli*, or eukaryotic cells such as yeast, insect, amphibian, or mammalian cells. Preferably, host cells are monocotyledonous or dicotyledonous plant cells. A particularly preferred monocotyledonous host cell is a maize host cell.

The term "hybridization complex" includes reference to a duplex nucleic acid structure formed by two single-stranded nucleic acid sequences selectively hybridized with each other.

By "immunologically reactive conditions" or "immunoreactive conditions" is meant conditions which allow an antibody, reactive to a particular epitope, to bind to that epitope to a detectably greater degree (e.g., at least 2-fold over background) than the antibody binds to substantially any other epitopes in a reaction mixture comprising the particular epitope. Immunologically reactive conditions are dependent upon the format of the antibody binding reaction and typically are those utilized in immunoassay protocols. See Harlow and Lane, Antibodies, A Laboratory Manual, Cold Spring Harbor Publications, New York (1988), for a description of immunoassay formats and conditions.

The term "introduced" in the context of inserting a nucleic acid into a cell, means "transfection" or "transformation" or "transduction" and includes reference to the incorporation of a nucleic acid into a eukaryotic or prokaryotic cell where the nucleic acid may be incorporated into the genome of the cell (e.g., chromosome, plasmid, plastid or mitochondrial DNA), converted into an autonomous replicon, or transiently expressed (e.g., transfected mRNA).

The term "isolated" refers to material, such as a nucleic acid or a protein, which is: (1) substantially or essentially free from components that normally accompany or interact with it as found in its naturally occurring environment. The isolated material optionally comprises material not found with the material in its natural environment; or (2) if the material is in its natural environment, the material has been synthetically (non-naturally) altered by deliberate human intervention to a composition and/or placed at a location in the cell (e.g., genome or subcellular organelle) not native to a material found in that environment. The alteration to yield the synthetic material can be performed on the material within or removed from its natural state. For example, a naturally occurring nucleic acid becomes an isolated nucleic acid if it is altered, or if it is transcribed from DNA which has been altered, by means of human intervention performed within the cell from which it originates. See, e.g., Compounds and Methods for Site Directed Mutagenesis in Eukaryotic Cells, Kmiec, U.S. Pat. No. 5,565,350; In Vivo Homologous Sequence Targeting in Eukaryotic Cells; Zarling et al., PCT/US93/03868. Likewise, a naturally occurring nucleic acid (e.g., a promoter) becomes isolated if it is introduced by nonnaturally occurring means to a locus of the genome not native to that nucleic acid. Nucleic acids which are "isolated" as defined herein, are also referred to as "heterologous" nucleic acids.

As used herein, "localized within the chromosomal region defined by and including" with respect to particular markers includes reference to a contiguous length of a chromosome delimited by and including the stated markers.

As used herein, "marker" includes reference to a locus on a chromosome that serves to identify a unique position on the chromosome. A "polymorphic marker" includes reference to a marker which appears in multiple forms (alleles) such that different forms of the marker, when they are present in a homologous pair, allow transmission of each of the chromosomes of that pair to be followed. A genotype may be defined by use of one or a plurality of markers.

As used herein, "nucleic acid" includes reference to a deoxyribonucleotide or ribonucleotide polymer in either single- or double-stranded form, and unless otherwise limited, encompasses known analogues having the essential nature of natural nucleotides in that they hybridize to single-stranded nucleic acids in a manner similar to naturally occurring nucleotides (e.g., peptide nucleic acids).

By "nucleic acid library" is meant a collection of isolated DNA or RNA molecules which comprise and substantially represent the entire transcribed fraction of a genome of a specified organism. Construction of exemplary nucleic acid libraries, such as genomic and cDNA libraries, is taught in standard molecular biology references such as Berger and Kimmel, Guide to Molecular Cloning Techniques, Methods in Enzymology, Vol. 152, Academic Press, Inc., San Diego, Calif. (Berger); Sambrook et al., Molecular Cloning—A Laboratory Manual, 2nd ed., Vol. 1-3 (1989); and Current Protocols in Molecular Biology, F. M. Ausubel et al., Eds., Current Protocols, a joint venture between Greene Publishing Associates, Inc. and John Wiley & Sons, Inc. (1994).

As used herein "operably linked" includes reference to a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame.

As used herein, the term "plant" includes reference to whole plants, plant organs (e.g., leaves, stems, roots, etc.), seeds and plant cells and progeny of same. Plant cell, as used herein includes, without limitation, seeds, suspension cultures, embryos, meristematic regions, callus tissue, leaves, roots, shoots, gametophytes, sporophytes, pollen, and microspores. The class of plants which can be used in the methods of the invention is generally as broad as the class of higher plants amenable to transformation techniques, including both monocotyledonous and dicotyledonous plants. A particularly preferred plant is *Zea mays*.

As used herein, "polynucleotide" includes reference to a deoxyribopolynucleotide, ribopolynucleotide, or analogs thereof that have the essential nature of a natural ribonucleotide in that they hybridize, under stringent hybridization conditions, to substantially the same nucleotide sequence as naturally occurring nucleotides and/or allow translation into the same amino acid(s) as the naturally occurring nucleotide(s). A polynucleotide can be full-length or a subsequence of a native or heterologous structural or regulatory gene. Unless otherwise indicated, the term includes reference to the specified sequence as well as the complementary sequence thereof. Thus, DNAs or RNAs with backbones modified for stability or for other reasons are "polynucleotides" as that term is intended herein. Moreover, DNAs or RNAs comprising unusual bases, such as inosine, or modified bases, such as tritylated bases, to name just two examples, are polynucleotides as the term is used herein. It will be appreciated that a great variety of modifications have been made to DNA and RNA that serve many useful purposes known to those of skill in the art.

The term polynucleotide as it is employed herein embraces such chemically, enzymatically or metabolically modified forms of polynucleotides, as well as the chemical forms of DNA and RNA characteristic of viruses and cells, including among other things, simple and complex cells.

The terms "polypeptide", "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The essential nature of such analogues of naturally occurring amino acids is that, when incorporated into a protein, that protein is specifically reactive to antibodies elicited to the same protein but consisting entirely of naturally occurring amino acids. The terms "polypeptide", "peptide" and "protein" are also inclusive of modifications including, but not limited to, glycosylation, lipid attachment, sulfation, gamma-carboxylation of glutamic acid residues, hydroxylation and ADP-ribosylation. It will be appreciated, as is well known and as noted above, that polypeptides are not always entirely linear. For instance, polypeptides may be branched as a result of ubiquitization, and they may be circular, with or without branching, generally as a result of posttranslation events, including natural processing event and events brought about by human manipulation which do not occur naturally. Circular, branched and branched circular polypeptides may be synthesized by non-translation natural process and by entirely synthetic methods, as well. Further, this invention contemplates the use of both the methionine-containing and the methionine-less amino terminal variants of the protein of the invention.

As used herein "promoter" includes reference to a region of DNA upstream from the start of transcription and involved in recognition and binding of RNA polymerase and other proteins to initiate transcription. A "plant promoter" is a promoter capable of initiating transcription in plant cells whether or not its origin is a plant cell. Exemplary plant promoters include, but are not limited to, those that are obtained from plants, plant viruses, and bacteria which comprise genes expressed in plant cells such *Agrobacterium* or *Rhizobium*. Examples of promoters under developmental control include promoters that preferentially initiate transcription in certain tissues, such as leaves, roots, or seeds. Such promoters are referred to as "tissue preferred". Promoters which initiate transcription only in certain tissue are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions or the presence of light. Tissue specific, tissue preferred, cell type specific, and inducible promoters constitute the class of "non-constitutive" promoters. A "constitutive" promoter is a promoter which is active under most environmental conditions.

The term "xylan synthase polypeptide" is a polypeptide of the present invention and refers to one or more amino acid sequences, in glycosylated or non-glycosylated form. The term is also inclusive of fragments, variants, homologs, alleles or precursors (e.g., preproproteins or proproteins) thereof which have xylan synthase activity. A "xylan synthase protein" is a protein of the present invention and comprises a xylan synthase polypeptide with xylan synthase activity.

As used herein "recombinant" includes reference to a cell or vector, that has been modified by the introduction of a heterologous nucleic acid or that the cell is derived from a cell so modified. Thus, for example, recombinant cells express genes that are not found in identical form within the native (non-recombinant) form of the cell or express native genes that are otherwise abnormally expressed, under-expressed or not expressed at all as a result of deliberate human intervention. The term "recombinant" as used herein does not encompass the alteration of the cell or vector by naturally occurring events (e.g., spontaneous mutation, natural transformation/transduction/transposition) such as those occurring without deliberate human intervention.

As used herein, a "recombinant expression cassette" is a nucleic acid construct, generated recombinantly or synthetically, with a series of specified nucleic acid elements which permit transcription of a particular nucleic acid in a host cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid to be transcribed, and a promoter.

The term "residue" or "amino acid residue" or "amino acid" are used interchangeably herein to refer to an amino acid that is incorporated into a protein, polypeptide, or peptide (collectively "protein"). The amino acid may be a naturally occurring amino acid and, unless otherwise limited, may encompass non-natural analogs of natural amino acids that can function in a similar manner as naturally occurring amino acids.

The term "selectively hybridizes" includes reference to hybridization, under stringent hybridization conditions, of a nucleic acid sequence to a s other biologics. Thus, under designated immunoassay conditions, the specified antibodies bind to an analyte having the recognized epitope to a substantially greater degree (e.g., at least 2-fold over background) than to substantially all analytes lacking the epitope which are present in the sample. Specific binding to an antibody under such conditions may require an antibody that is selected for its specificity for a particular protein. For example, antibodies raised to the polypeptides of the present invention can be selected from to obtain antibodies specifically reactive with polypeptides of the present invention. The proteins used as immunogens can be in native conformation or denatured so as to provide a linear epitope.

A variety of immunoassay formats may be used to select antibodies specifically reactive with a particular protein (or other analyte). For example, solid-phase ELISA immunoassays are routinely used to select monoclonal antibodies specifically immunoreactive with a protein. See Harlow and Lane, Antibodies, A Laboratory Manual, Cold Spring Harbor Publications, New York (1988), for a description of immunoassay formats and conditions that can be used to determine selective reactivity.

The term "stringent conditions" or "stringent hybridization conditions" includes reference to conditions under which a probe will hybridize to its target sequence, to a detectably greater degree than to other sequences (e.g., at least 2-fold over background). Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 MNaCl, 1% SDS (sodium dodecyl sulphate) at 37° C., and a wash in 1× to 2×SSC (20×SSC=3.0 MNaCl/0.3 M trisodium citrate) at 50 to 55° C. Exemplary moderate stringency conditions include hybridization in 40 to 45% formamide, 1 MNaCl, 1% SDS at 37° C., and a wash in <RTI 0.5× to 1×SSC at 55 to 60° C. Exemplary high stringency conditions include hybridization in 50% formamide, 1 MNaCl, 1% SDS at 37° C., and a wash in 0.1×SSC at 60 to 65° C. Specificity is typically the function of post-hybridization washes, the critical factors being the ionic strength and temperature of the final wash solution. For DNA/DNA hybrids, the Tm can be approximated from the equation of Meinkoth and Wahl, Anal. Biochem., 138: 267-284 (1984): Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm, hybridization and/or wash conditions can be adjusted to hybridize to sequences of the desired identity. For example, if sequences with >90% identity are sought, the Tm can be decreased 10° C. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3, or 4° C. lower than the thermal melting point (Tm); moderately stringent conditions can utilize a hybridization and/or wash at 6, 7, 8, 9, or 10° C. lower than the thermal melting point (Tm); low stringency conditions can utilize a hybridization and/or wash at 11, 12, 13, 14, 15, or 20° C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution) it is preferred to increase the SSC concentration so that a higher temperature can be used. An extensive guide to the hybridization of nucleic acids is found in Tijssen, Laboratory Techniques in Biochemistry and Molecular Biology—Hybridization with Nucleic Acid Probes, Part I, Chapter 2 "Overview of principles of hybridization and the strategy of nucleic acid probe assays", Elsevier, New York (1993); and Current Protocols in Molecular Biology, Chapter 2, Ausubel, et al., Eds., Greene Publishing and Wiley-Interscience, New York (1995).

As used herein, "transgenic plant" includes reference to a plant which comprises within its genome a heterologous polynucleotide. Generally, the heterologous polynucleotide is stably integrated within the genome such that the polynucleotide is passed on to successive generations. The heterologous polynucleotide may be integrated into the genome alone or as part of a recombinant expression cassette. "Transgenic" is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non recombinant viral infection, non-recombinant bacterial transformation, non-recombinant transposition, or spontaneous mutation.

As used herein, "vector" includes reference to a nucleic acid used in transfection of a host cell and into which can be inserted a polynucleotide. Vectors are often replicons. Expression vectors permit transcription of a nucleic acid inserted therein.

The following terms are used to describe the sequence relationships between a polynucleotide/polypeptide of the present invention with a reference polynucleotide/polypeptide: (a)"reference sequence", (b) "comparison window", (c) "sequence identity", and (d) "percentage of sequence identity".

(a) As used herein, "reference sequence" is a defined sequence used as a basis for sequence comparison with a polynucleotide/polypeptide of the present invention. A reference sequence may be a subset or the entirety of a specified sequence; for example, as a segment of a full-length cDNA or gene sequence, or the complete cDNA or gene sequence.

(b) As used herein, "comparison window" includes reference to a contiguous and specified segment of a polynucleotide/polypeptide sequence, wherein the polynucleotide/polypeptide sequence may be compared to a reference sequence and wherein the portion of the polynucleotide/polypeptide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides/amino acids residues in length, and optionally can be 30, 40, 50, 100, or longer. Those of skill in the art understand that to avoid a high similarity to a reference sequence due to inclusion of gaps in the polynucleotide/polypeptide sequence, a gap penalty is typically introduced and is subtracted from the number of matches.

Methods of alignment of sequences for comparison are well-known in the art. Optimal alignment of sequences for comparison may be conducted by the local homology algorithm of Smith and Waterman, Adv. Appl. Math. 2: 482 (1981); by the homology alignment algorithm of Needleman and Wunsch, J. Mol. Biol. 48: 443 (1970); by the search for similarity method of Pearson and Lipman, Proc. Natl. Acad. Sci. 85: 2444 (1988); by computerized implementations of these algorithms, including, but not limited to: CLUSTAL in the PC/Gene program by Intelligenetics, Mountain View, Calif.; GAP, BESTFIT, BLAST, FASTA, and TFASTA in the . . . in the GCG Wisconsin Genetics Software Package, Version 10 (available from Accelrys Inc., 9685 Scranton Road, San Diego, Calif., USA). The CLUSTAL program is well described by Higgins and Sharp, Gene 73: 237-244 (1988); Higgins and Sharp, CABIOS 5: 151-153 (1989); Corpet, et al., Nucleic Acids Research 16: 10881-90 (1988); Huang, et al., Computer Applications in the Biosciences 8: 155-65 (1992), and Pearson, et al., Methods in Molecular Biology 24: 307-331 (1994).

The BLAST family of programs which can be used for database similarity searches includes: BLASTN for nucleotide query sequences against nucleotide database sequences; BLASTX for nucleotide query sequences against protein database sequences; BLASTP for protein query sequences against protein database sequences; TBLASTN for protein query sequences against nucleotide database sequences; and TBLASTX for nucleotide query sequences against nucleotide database sequences. See, Current Protocols in Molecular Biology, Chapter 19, Ausubel, et al., Eds., Greene Publishing and Wiley-Interscience, New York (1995); Altschul et al., J. Mol. Biol., 215: 403-410 (1990); and, Altschul et al., Nucleic Acids Res. 25: 3389-3402 (1997).

Software for performing BLAST analyses is publicly available, e.g., through the National Center for Biotechnology Information on the world wide web. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold. These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score.

Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word length (W) of 11, an expectation (E) of 10, a cutoff of 100, M=5, N=−4, and a comparison of both strands. For amino acid sequences, the BLASTP program uses as defaults a word length (W) of 3, an expectation (E) of 10, and the BLOSUM62 scoring matrix (see Henikoff & Henikoff (1989) Proc. Natl. Acad. Sci. USA 89:10915).

In addition to calculating percent sequence identity, the BLAST algorithm also performs a statistical analysis of the similarity between two sequences (see, e.g., Karlin & Altschul, Proc. Nat'l. Acad. Sci. USA 90: 5873-5877 (1993)). One measure of similarity provided by the BLAST algorithm is the smallest sum probability (P (N)), which provides an indication of the probability by which a match between two nucleotide or amino acid sequences would occur by chance. BLAST searches assume that proteins can be modeled as random sequences. However, many real proteins comprise regions of nonrandom sequences which may be homopolymeric tracts, short-period repeats, or regions enriched in one or more amino acids. Such low-complexity regions may be aligned between unrelated proteins even though other regions of the protein are entirely dissimilar. A number of low-complexity filter programs can be employed to reduce such low-complexity alignments. For example, the SEG (Wooten and Federhen, Comput. Chem., 17: 149-163 (1993)) and XNU (Claverie and States, Comput. Chem., 17: 191-201 (1993)) low-complexity filters can be employed alone or in combination.

Unless otherwise stated, nucleotide and protein identity/similarity values provided herein are calculated using GAP (GCG Version 10) under default values. GAP (Global Alignment Program) can also be used to compare a polynucleotide or polypeptide of the present invention with a reference sequence. GAP uses the algorithm of Needleman and Wunsch (J. Mol. Biol. 48:443-453, 1970) to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the Wisconsin Genetics Software Package for protein sequences are 8 and 2, respectively. For nucleotide sequences the default gap creation penalty is 50 while the default gap extension penalty is 3. The gap creation and gap extension penalties can be expressed as an integer selected from the group of integers consisting of from 0 to 100. Thus, for example, the gap creation and gap extension penalties can each independently be: 3, 4, 5, 6, 7, 8, 9, 10, 15, 20, 30, 40, 50, 60 or greater.

GAP presents one member of the family of best alignments. There may be many members of this family, but no other member has a better quality. GAP displays four figures of merit for alignments: Quality, Ratio, Identity, and Similarity. The Quality is the metric maximized in order to align the sequences. Ratio is the quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold. The scoring matrix used in Version 10 of the Wisconsin Genetics Software Package is BLOSUM62 (see Henikoff & Henikoff (1989) Proc. Natl. Acad. Sci. USA 89: 10915).

Multiple alignment of the sequences can be performed using the CLUSTAL method of alignment (Higgins and Sharp (1989) CABIOS. 5: 151-153) with the default parameters (GAPPENALTY=10, GAP LENGTH PENALTY=10). Default parameters for pairwise alignments using the CLUSTAL method are KTUPLE 1, GAP PENALTY=3, WINDOW=5 and DIAGONALS SAVED=5.

(c) As used herein, "sequence identity" or "identity" in the context of two nucleic acid or polypeptide sequences includes reference to the residues in the two sequences which are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are said to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, Computer Applic. Biol. Sci., 4:11-17 (1988) e. <RTI g., as implemented in the program PC/GENE (Intelligenetics, Mountain View, Calif., USA).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

DETAILED DESCRIPTION OF THE FIGURES

The patent or application file contains at least one drawing executed in color. Copies of this patent or patent application publication with color drawing(s) will be provided by the Office upon request and payment of the necessary fee.

FIG. 1 is a picture showing psyllium developing fruit and its cross-section.

FIG. 2 comprises two graphs showing fresh weight and hemicellulose level per seed coat plotted against days after flowering. As can be seen, hemicellulose accumulation exhibited a linear increase from 6 to 10 days after fertilization.

FIG. 3 shows the sugar composition of psyllium and corn callus. The sugar compositions are quite similar.

Figure 1:
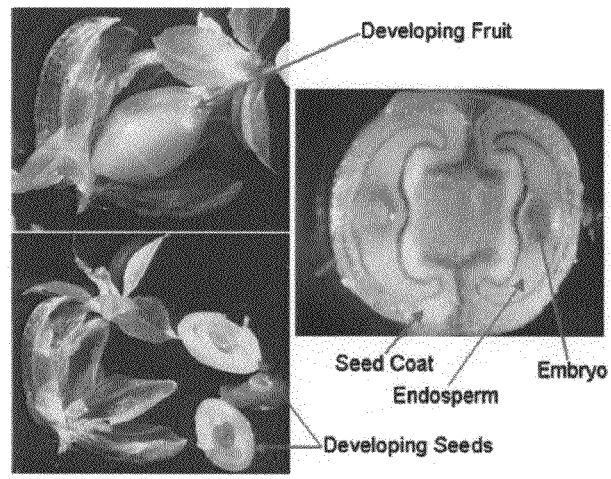

FIG. 5 shows a global sequence alignment of CesA and Csl sequences from multiple species. The conserved residues across the CesA and Csl sequences are marked with asterisks. The ones that are unique to Cs1A sequences are marked with the # sign. The sequences presented in the Figure are AtCesA1 (SEQ ID NO: 22), AtCesA10 (SEQ ID NO: 23), ZmCesA1 (SEQ ID NO: 95), ZmCesA2 (SEQ ID NO: 100), ZmCesA3 (SEQ ID NO: 101), AtCesA2 (SEQ ID NO: 24), AtCesA9 (SEQ ID NO: 31), AtCesA5 (SEQ ID NO: 27), AtCesA6 (SEQ ID NO: 28), ZmCesA6 (SEQ ID NO: 104), ZmCesA7 (SEQ ID NO: 105), ZmCesA8 (SEQ ID NO: 106), AtCesA3 (SEQ ID NO: 25), ZmCesA4 (SEQ ID NO: 102), ZmCesA9 (SEQ ID NO: 107), ZmCesA5 (SEQ ID NO: 103), AtCesA7 (SEQ ID NO: 29), ZmCesA12 (SEQ ID NO: 98), ZmCesA13 (SEQ ID NO: 99), AtCesA4 (SEQ ID NO: 26), ZmCesA10 (SEQ ID NO: 96), AtCesA8 (SEQ ID NO: 30), ZmCesA11 (SEQ ID NO: 97), AtCs1D1 (SEQ ID NO: 52), AtCs1D2 (SEQ ID NO: 53), AtCs1D3 (SEQ ID NO: 54), OsCs1D2 (SEQ ID NO: 80), OsCs1D1 (SEQ ID NO: 79), AtCs1D4 (SEQ ID NO: 55), OsCs1D3 (SEQ ID NO: 81), AtCs1D5 (SEQ ID NO: 56), AtCs1D6 (SEQ ID NO: 57), OsCs1F7 (SEQ ID NO: 88), OsCs1F1 (SEQ ID NO: 84), OsCs1F2 (SEQ ID NO: 85), OsCs1F4 (SEQ ID NO: 87), OsCs1F3 (SEQ ID NO: 86), AtCs1B1 (SEQ ID NO: 41), AtCs1B2 (SEQ ID NO: 42), AtCs1B4 (SEQ ID NO: 44), AtCs1B3 (SEQ ID NO: 43), AtCs1B5 (SEQ ID NO: 45), AtCs1B6 (SEQ ID NO: 46), OsCs1H1 (SEQ ID NO: 89), OsCs1H2 (SEQ ID NO: 90), AtCs1E1 (SEQ ID NO: 58), OsCs1E1 (SEQ ID NO: 82), OsCs1E5 (SEQ ID NO: 83), AtCs1G1 (SEQ ID NO: 59), AtCs1G2 (SEQ ID NO: 60), AtCs1G3 (SEQ ID NO: 61), AtCs1C12 (SEQ ID NO: 47), OsCs1C1 (SEQ ID NO: 74), OsCs1C7 (SEQ ID NO: 77), OsCs1C9 (SEQ ID NO: 78), AtCs1C5 (SEQ ID NO: 49), AtCs1C8 (SEQ ID NO: 51), OsCs1C3 (SEQ ID NO: 76), OsCs1C2 (SEQ ID NO: 75), AtCs1C4 (SEQ ID NO: 48), AtCs1C6 (SEQ ID NO: 50), OsCs1A8 (SEQ ID NO: 72), OsCs1A2 (SEQ ID NO: 66), OsCs1A4 (SEQ ID NO: 68), OsCs1A5 (SEQ ID NO: 69), OsCs1A7 (SEQ ID NO: 71), OsCs1A3 (SEQ ID NO: 67), OsCs1A11 (SEQ ID NO: 65), OsCs1A6 (SEQ ID NO: 70), AtCs1A1 (SEQ ID NO: 32), AtCs1A10 (SEQ ID NO: 33), AtCs1A15 (SEQ ID NO: 36), AtCs1A11 (SEQ ID NO: 34), AtCs1A14 (SEQ ID NO: 35), AtCs1A3 (SEQ ID NO: 38), AtCs1A7 (SEQ ID NO: 39), AtCs1A2 (SEQ ID NO: 37), PoXy1S (SEQ ID NO: 91), OsCs1A1 (SEQ ID NO: 64), OsCs1A9 (SEQ ID NO: 73), AtCs1A9 (SEQ ID NO: 40), PtCs1A1 (SEQ ID NO: 93), PtCs1A2 (SEQ ID NO: 94), CtManS (SEQ ID NO: 63), PpCs1A1 (SEQ ID NO: 92), and Consensus (SEQ ID NO: 62).

FIG. 6 shows an alignment of selected CsIA amino acid sequences from *Arabidopsis*, maize, and rice along with the sequences of psyllium XyIS and guar ManS. The conserved motifs (D, DXD, D, QXXRW) diagnostic of polymerizing b-glycosyltransferases are shown in asterisks. The residues specific to CsIA sequences are marked with the # sign. The sequences presented in the Figure are AtCs1A1 (SEQ ID NO: 32), AtCs1A10 (SEQ ID NO: 33), AtCs1A11 (SEQ ID NO: 34), AtCs1A15 (SEQ ID NO: 36), AtCs1A14 (SEQ ID NO: 35), AtCs1A3 (SEQ ID NO: 38), AtCs1A7 (SEQ ID NO: 39), AtCs1A2 (SEQ ID NO: 37), PoXylS (SEQ ID NO: 91), AtCs1A9 (SEQ ID NO: 40), PtCs1A1 (SEQ ID NO: 94), CtManS (SEQ ID NO: 63), and PpCs1A1 (SEQ ID NO: 92).

FIG. 7 shows an analysis of the cDNA sequence of 2 Cs1A genes and identifies a stretch of highly homologous regions (highlighted in green). The sequences presented in the Figure are AtCs1A2 (SEQ ID NO: 19), AtCs1A9 (SEQ ID NO: 20), and Concensus (SEQ ID NO: 21).

Figure 8A:
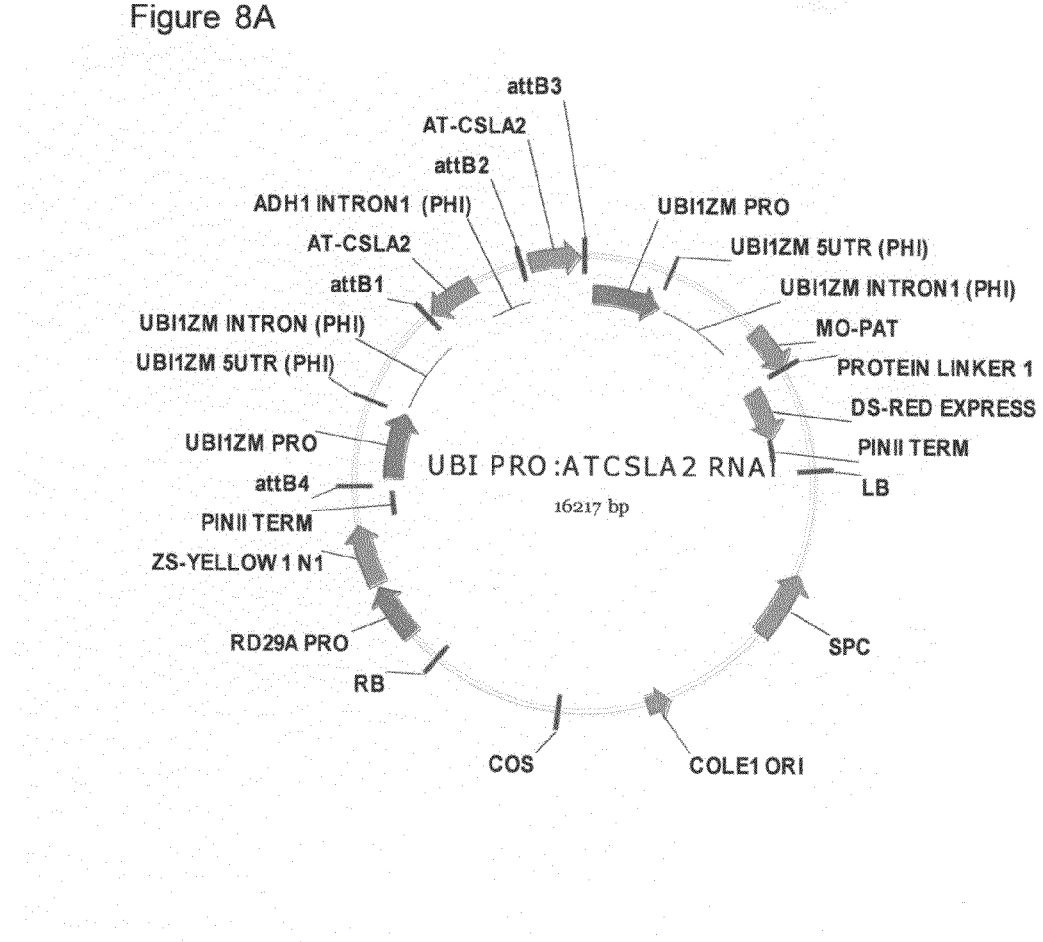
Figure 8B:
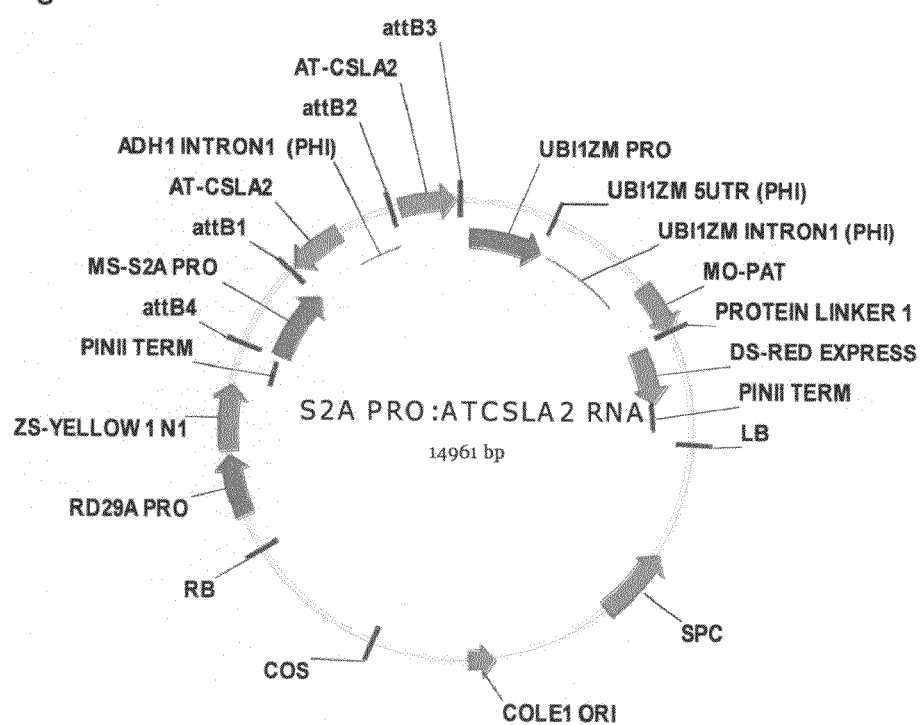

FIGS. 8A and 8B show the design of two vectors for use in the invention.

Figure 9:
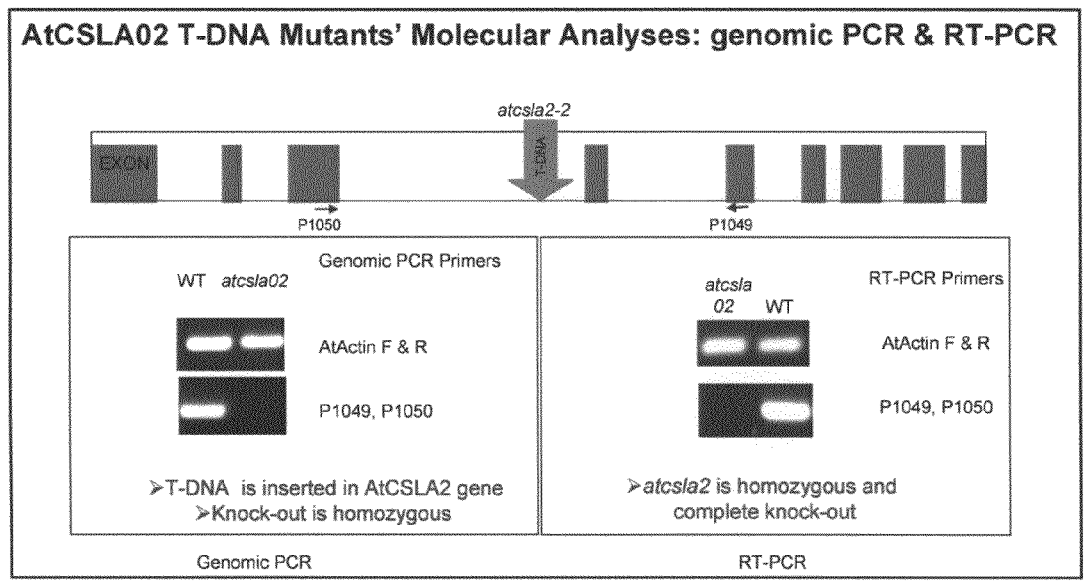

FIG. 9 shows functional analysis of ATCSLA2 demonstrating that the T-DNA is inserted in the ATCSLA2 gene.

Figure 10:
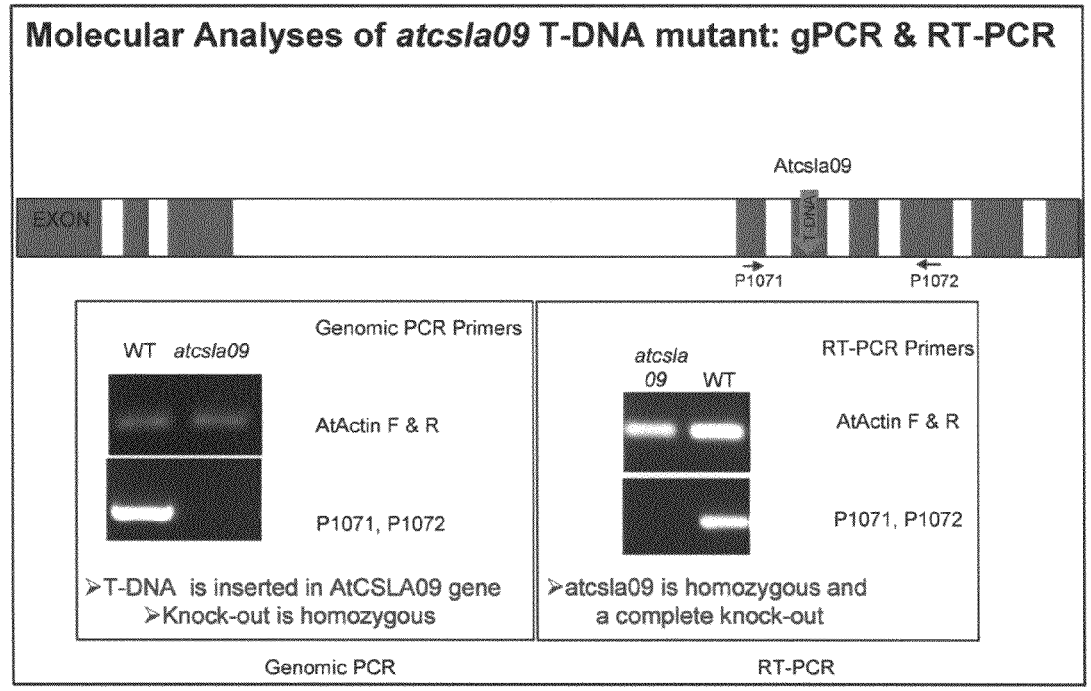

FIG. 10 shows functional analysis of ATCSLA9 demonstrating that the T-DNA is inserted in the ATCSLA9 gene.

Figure 11:
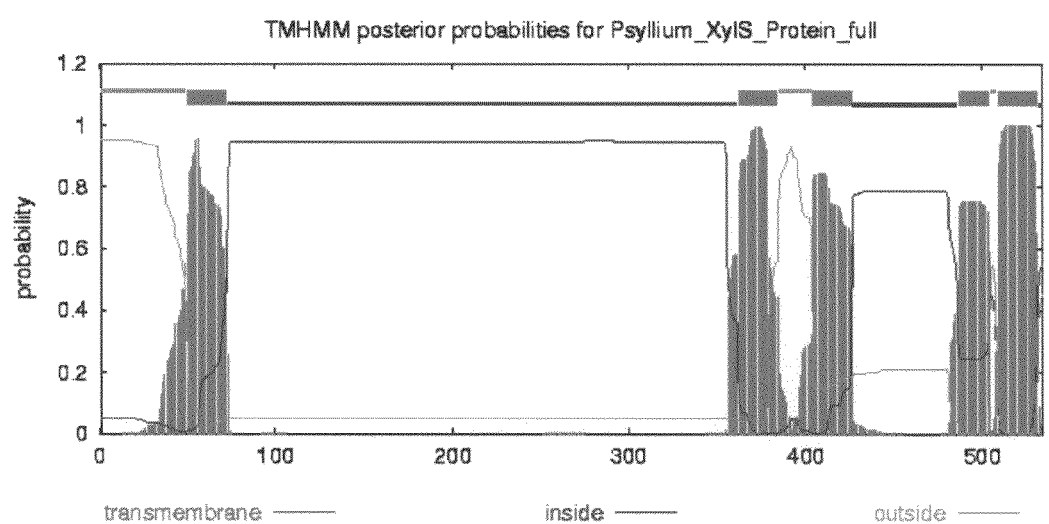

FIG. 11 shows the five putative transmembrane domains, identified by the TMHMM program (http://www.cbs.dtu.dk/services/TMHMM-2.0/), in the psyllium xylan synthase protein. One near the N terminus and four near the C-terminus were found, suggesting that the N-terminal end of the protein is in the cytosol.

Figure 12B:
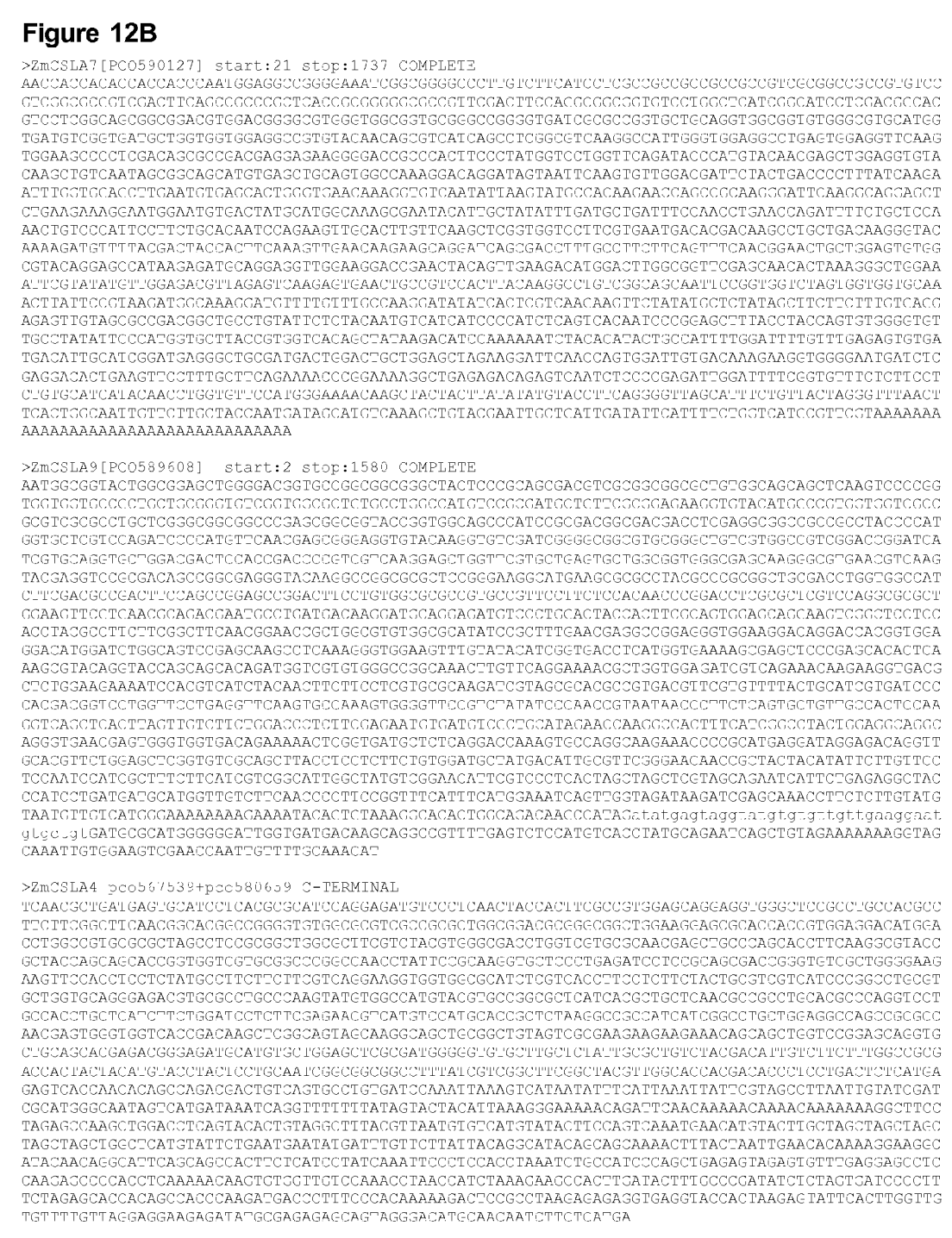

FIG. 12 shows several examples of maize Cs1A sequences for use in the methods of the invention. The sequences presented in the Figure are ZmCSLA1 (SEQ ID NO:3), ZmCSLA2 (SEQ ID NO: 5), ZmCSLA6 (SEQ ID NO: 11), ZmCSLA7 (SEQ ID NO: 13), ZmCSLA9 (SEQ ID NO: 17), ZmCSLA4 (SEQ ID NO: 9), ZmCSLA8 (SEQ ID NO: 15), and ZmCSLA3 (SEQ ID NO: 7).

FIG. 13 shows maize Cs1A predicted protein sequences from the sequences in FIG. 12. The sequences presented in the Figure are ZmCSLA1 (SEQ ID NO:4), ZmCSLA2 (SEQ ID NO: 6), ZmCSLA6 (SEQ ID NO: 12), ZmCSLA7 (SEQ ID NO: 14), ZmCSLA9 (SEQ ID NO: 18), ZmCSLA4 (SEQ ID NO: 10), ZmCSLA8 (SEQ ID NO: 16), and ZmCSLA3 (SEQ ID NO: 8).

FIG. 14 shows the novel Psyllium nucleotide sequence of the invention. The sequence presented in the Figure is Psyllium Xyls NT full (SEQ ID NO: 1).

FIG. 15 shows the predicted amino acid sequence of the psyllium xylan synthase of the invention. The residues D, DXD, D, and QXXRW (highlighted and underlined in bold red, reading from left to right of the sequence) are conserved across polymerizing beta-glycosyltransferases. In addition, the residue C that is six amino acids upstream of the DXD motif, another C that is one amino acid downstream of the QXXRW motif, and an A that is four amino acids downstream of the QXXRW motif appear to be specific to this class (xylan synthase) of proteins. The sequence presented in the Figure is PoXy1S (SEQ ID NO: 2).

DETAILED DESCRIPTION OF THE INVENTION

The present invention provides methods compositions and for the modulation of xylan synthase and concomitant XA levels in a cereal plant. Compositions are nucleic acid molecules comprising novel nucleotide sequences encoding polypeptides that are involved in polysaccharide synthesis, hereinafter referred to as "xylan synthases."

By "xylan synthesis" or "synthesis of xylan(s)" is intended any enzyme that catalyzes the synthesis of the β 1,4-linked xylose residues, the sequences disclosed herein and for use in the methods of the invention may synthesize xylan by catalyzing glycosidic linkages extending the xylan polymer, hence polypeptides having xylan synthase activity are characterized by the ability to accelerate the chemical modification of a xylosyl molecule.

In addition to the novel isolated xylan synthase disclosed herein, the xylan synthases of the invention are characterized by their classification as CslA enzymes and their sequence similarity to the same. These enzymes have not previously been known to have xylan synthase activity. While they have been known to be involved in polysaccharide synthesis, a complex process, the cellulose synthase-like enzymes, subfamily group A represent a class of enzymes which now have been shown to have xylan synthase activity. The Csl polypeptides useful for the invention will share amino-acid-sequence homology to known cellulose synthases and these known sequences may also be used to isolate other yet to be identified CslA enzymes. The Csl polypeptides contain a QxxRW motif, which may form the substrate binding and catalytic sites of these enzymes (Richmond et al. (2000) *Plant Physiology* 124: 495-498), as well as 3-6 transmembrane domains at the carboxy-terminus and 1-2 transmembrane domains at the amino-terminus. Transmembrane domains anchor polypeptides to membranes, including, for example, the Golgi apparatus membrane. The polypeptides responsible for synthesis of polysaccharides other than cellulose and callose, such as hemicelluloses and pectins, are membrane-associated (WO 99/67404). In fact, polypeptides encoded by several Csl genes have been localized to the Golgi apparatus and endoplasmic reticulum where synthesis of polysaccharides occurs (Favery et al. (2001) *Genes Dev.* 15:79-89; Ray et al. (1976) *Ber. Deutsch Bot. Ges. Bd.* 89:121-146 [cited in WO 99/67404]). FIG. 12 shows several examples of maize CslA nucleotide sequences for use in the methods of the invention. FIG. 13 shows maize CslA predicted protein sequences from the sequences in FIG. 12. In addition, FIGS. 5, 6, 7, and 16 show areas of conserved residues of CesA, Csl and CslA sequences which will help to identify other such sequences for use in the invention.

According to the invention, Csl A polypeptides have xylan synthase activity and may be manipulated to alter the overall polysaccharide composition of a plant cell, tissue, or organ. Thus the xylan synthases for use in the invention will belong to the Csl subgroup A clade, and will likely have the QxxRW motif and at least 4 transmembrane domains. Hence, the sequences of the invention may find use in the modulation of polysaccharide levels, and in helping to identify other enzymes which will have xylan synthase activity.

In one embodiment of the invention a method for improving the digestibility of grain crops is provided. By "digestibility" is intended the percentage of a substance taken into a digestive tract that is absorbed by the body. Arabinoxylans constitute 45%-65% of the grain cell wall, but they impede digestion of the grain and may sequester digestible components of grain thus reducing digestibility (WO 99/67404; van der Klis et al. (1995) *Anim. Feed Sci. & Tech.* 51:15-27). The high levels of undigestible material contribute to the sanitation challenges of livestock and poultry raising (Selinger et al. (1996) *Anaerobe* 2:263-284). The methods for modulating polysaccharide synthase levels can be used to increase digestibility of grain and forage crops by lowering the concentration of polysaccharide synthases, thereby lowering the concentration of hemicelluloses, such as arabinoxylan, in the modified plant. Tissue-specific promoters can be used to direct down regulation of expression of the nucleotide sequences of the invention in the desired plant tissues using antisense or sense-suppression technology as described elsewhere herein.

Methods to measure digestibility are known in the art and include, but are not limited to, determining the food conversion ratio (WO 99/67404), sampling chyme for chromium, phosphorous, calcium, magnesium, sodium, and potassium (van der Klis et al. (1995) *Anim. Feed Sci. & Tech.* 51:15-27), in sacco degradation (van Vuuren et al. (1989) *Grass & Forage Sci.* 44: 223-230), growth studies (GrootWassink et al. (1989) *J. Sci. Food Agric.* 46:289-300), and the enzyme digestible dry matter (EDDM) assay (Boisen and Fernandez (1997) *Animal Feed Sci. Tech.* 68:83-92; and Boisen and Fernandez (1995) *Animal Feed Sci. Tech.* 51:29-43); all of which are herein incorporated by reference. Such methods can be used to determine the digestibility and/or energy availability of the plant parts of plants modified in accordance with methods of the invention. The modified plant parts, such as modified grain, may be fed to a variety of livestock including, but not limited to, poultry, cattle, swine, horses, and sheep.

In another embodiment of the invention a method for improving gum extractability is provided. By "gum" is intended any of numerous colloidal polysaccharides of plant origin that are gelatinous when moist but which harden on drying, including, but not limited to, arabinoxylans, galactans, and mixed-link glucans. Whereas high gum concentration can be detrimental to digestibility, there is a strong interest in their industrial applications, such as their use as thickeners in the food industry (Sanderson (1982) *Prog. Fd. Nutr. Sci.* 6:77-87). About 15% of the total corn produced in the USA is subjected to wet milling to produce mainly starch and also oil from the germ. Wet milling is a multi-step process involving the steeping and grinding of kernels, and separating the kernels into starch, protein, oil, and fiber portions. See S. R. Eckhoff (1992) Proceedings of the 4$^{th}$ Corn Utilization Conference, Jun. 24-26, 1992, St. Louis, Mo., (National Corn Growers Association, CIBA-GEIGY Seed Division, and the USDA). The fiber residue left at the end of the wet-milling process is rich in arabinoxylans. However, it is not currently economically feasible to extract arabinoxylans from the wet-milled residue of corn. Increasing the level of arabinoxylans, galactans, or mixed-link glucans in the maize grain improves the ability to extract the gums. This can be achieved by generating a plant that overexpresses xylan synthases involved in synthesis of arabinoxylans, particularly overexpression in the tissue of interest, such as grain.

The following will describe techniques and compositions for uses of xylan synthase amino acids and nucleotide sequences of the invention. Reference to the amino acid and nucleotide sequences of the invention includes not only the novel psyllium sequence disclosed herein, but also to known and yet to be discovered CslA sequences such as SEQ ID NOS: 3, 5, 7, 9, 11, 13, 15, or 17 which now have been shown herein to have xylan synthase activity and which can be used according to the invention.

Nucleic Acids

The present invention provides, among other things, isolated nucleic acids of RNA, DNA, and analogs and/or chimeras thereof, comprising a xylan synthase encoding polynucleotide of the present invention.

A polynucleotide of the present invention is inclusive of:
(a) a polynucleotide encoding a polypeptide of SEQ ID NO: 2 and conservatively modified and polymorphic variants thereof, including exemplary polynucleotides of SEQ ID NO: 1;
(b) an isolated polynucleotide which is the product of amplification from a plant nucleic acid library using primer pairs which selectively hybridize under stringent conditions to loci within a polynucleotide of the present invention;
(c) an isolated polynucleotide which selectively hybridizes to a polynucleotide of (a) or (b);
(d) an isolated polynucleotide having a specified sequence identity with polynucleotides of (a), (b), or (c);
(e) an isolated polynucleotide encoding a protein having a specified number of contiguous amino acids from a prototype polypeptide, wherein the protein is specifically recognized by antisera elicited by presentation of the protein and wherein the protein does not detectably immunoreact to antisera which has been fully immunosorbed with the protein;

(f) complementary sequences of polynucleotides of (a), (b), (c), (d), or (e); and (g) an isolated polynucleotide comprising at least a specific number of contiguous nucleotides from a polynucleotide of (a), (b), (c), (d), (e), or (f);

(h) an isolated polynucleotide from a full-length enriched cDNA library having the physico-chemical property of selectively hybridizing to a polynucleotide of (a), (b), (c), (d), (e), (f), or (g);

(i) an isolated polynucleotide made by the process of: 1) providing a full-length enriched nucleic acid library, 2) selectively hybridizing the polynucleotide to a polynucleotide of (a), (b), (c), (d), (e), (f), (g), or (h), thereby isolating the polynucleotide from the nucleic acid library.

A. Polynucleotides Encoding a Xylan Synthase Polypeptide of the Present Invention As indicated in (a), above, the present invention provides novel isolated nucleic acids comprising a xylan synthase polynucleotide of the present invention, but also novel properties of CslA proteins. Every nucleic acid sequence herein that encodes a polypeptide also, by reference to the genetic code, describes every possible silent variation of the nucleic acid. One of ordinary skill will recognize that each codon in a nucleic acid (except AUG, which is ordinarily the only codon for methionine; and UGG, which is ordinarily the only codon for tryptophan) can be modified to yield a functionally identical molecule. Thus, each silent variation of a nucleic acid which encodes a polypeptide of the present invention is implicit in each described polypeptide sequence and is within the scope of the present invention. Accordingly, the present invention includes polynucleotides of the present invention and polynucleotides encoding a polypeptide of the present invention.

B. Polynucleotides Amplified from a Plant Nucleic Acid Library

As indicated in (b), above, the present invention provides an isolated nucleic acid comprising a xylan synthase polynucleotide of the present invention, wherein the polynucleotides are amplified, under nucleic acid amplification conditions, from a plant nucleic acid library. Such process may also be used with known CslA nucleic acids disclosed herein and in other sources such as Genbank to identify other sequences useful for the invention.

Nucleic acid amplification conditions for each of the'variety of amplification methods are well known to those of ordinary skill in the art. The plant nucleic acid library can be constructed from a monocot such as a cereal crop. Exemplary cereals include corn, sorghum, alfalfa, canola, wheat, or rice. The plant nucleic acid library can also be constructed from a dicot such as soybean. Zea mays lines B73, PHRE1, A632, BMP2#10, W23, and Mo17 are known and publicly available. Other publicly known and available maize lines can be obtained from the Maize Genetics Cooperation (Urbana, Ill.).

Wheat lines are available from the Wheat Genetics Resource Center (Manhattan, Kans.). The nucleic acid library may be a cDNA library, a genomic library, or a library generally constructed from nuclear transcripts at any stage of intron processing. cDNA libraries can be normalized to increase the representation of relatively rare cDNAs. In optional embodiments, the cDNA library is constructed using an enriched full-length cDNA synthesis method. Examples of such methods include Oligo-Capping (Maruyama, K. and Sugano, S. Gene 138: 171-174, 1994), Biotinylated CAP Trapper (Carninci, et al. Genomics 37:327-336, 1996), and CAP Retention Procedure (Edery, E., Chu, L. L., et al. Molecular and Cellular Biology 15:3363-3371, 1995). Rapidly growing tissues or rapidly dividing cells are preferred for use as an mRNA source for construction of a cDNA library. Growth stages of corn are described in "How a Corn Plant Develops," Special Report No. 48, Iowa State University of Science and Technology Cooperative Extension Service, Ames, Iowa, Reprinted February 1993.

A polynucleotide of this embodiment (or subsequences thereof) can be obtained, for example, by using amplification primers which are selectively hybridized and primer extended, under nucleic acid amplification conditions, to at least two sites within a polynucleotide of the present invention, or to two sites within the nucleic acid which flank and comprise a polynucleotide of the present invention, or to a site within a polynucleotide of the present invention and a site within the nucleic acid which comprises it. Methods for obtaining 5' and/or 3' ends of a vector insert are well known in the art. See, e.g., RACE (Rapid Amplification of Complementary Ends) as described in Frohman, M. A., in PCR Protocols: A Guide to Methods and Applications, M. A. Innis, D. H. Gelfand, J. J. Sninsky, T. J. White, Eds. (Academic Press, Inc., San Diego), pp. 28-38 (1990)); see also, U.S. Pat. No. 5,470,722, and Current Protocols in Molecular Biology, Unit 15.6, Ausubel, et al., Eds., Greene Publishing and Wiley-Interscience, New York (1995); Frohman and Martin, Techniques 1: 165 (1989).

Optionally, the primers are complementary to a subsequence of the target nucleic acid which they amplify but may have a sequence identity ranging from about 85% to 99% relative to the polynucleotide sequence which they are designed to anneal to. As those skilled in the art will appreciate, the sites to which the primer pairs will selectively hybridize are chosen such that a single contiguous nucleic acid can be formed under the desired nucleic acid amplification conditions. The primer length in nucleotides is selected from the group of integers consisting of from at least 15 to 50. Thus, the primers can be at least 15, 18, 20, 25, 30, 40, or 50 nucleotides in length. Those of skill will recognize that a lengthened primer sequence can be employed to increase specificity of binding (i.e., annealing) to a target sequence. A non-annealing sequence at the 5' end of a primer (a "tail") can be added, for example, to introduce a cloning site at the terminal ends of the amplicon.

The amplification products can be translated using expression systems well known to those of skill in the art. The resulting translation products can be confirmed as xylan synthase polypeptides of the present invention by, for example, assaying for the appropriate catalytic activity (e.g., specific activity and/or substrate specificity), or verifying the presence of one or more epitopes which are specific to a polypeptide of the present invention. Methods for protein synthesis from PCR derived templates are known in the art and available commercially. See, e.g., Amersham Life Sciences, Inc, Catalog '97, p. 354.

C. Polynucleotides which Selectively Hybridize to a Polynucleotide of (A) or (B)

As indicated in (c), above, the present invention provides isolated nucleic acids comprising xylan synthase encoding polynucleotides of the present invention, wherein the polynucleotides selectively hybridize, under selective hybridization conditions, to a polynucleotide of sections (A) or (B) as discussed above. Thus, the polynucleotides of this embodiment can be used for isolating, detecting, and/or quantifying nucleic acids comprising the polynucleotides of (A) or (B). For example, polynucleotides of the present invention can be used to identify, isolate, or amplify partial or full-length clones in a deposited library. This same process may also be applied to the known CslA sequences disclosed herein and known in the art to identify other CslA proteins which will have xylan synthase activity.

In some embodiments, the polynucleotides are genomic or cDNA sequences isolated or otherwise complementary to a cDNA from a dicot or monocot nucleic acid library.

Exemplary species of monocots and dicots include, but are not limited to: maize, canola, soybean, cotton, wheat, sorghum, sunflower, alfalfa, oats, sugar cane, millet, barley, switch grass as well as other prairie grasses, and rice. The cDNA library comprises at least 50% to 95% full-length sequences (for example, at least 50%, 60%, 70%, 80%, 90%, or 95% full-length sequences). The cDNA libraries can be normalized to increase the representation of rare sequences. See, e.g., U.S. Pat. No. 5,482,845. Low stringency hybridization conditions are typically, but not exclusively, employed with sequences having a reduced sequence identity relative to complementary sequences. Moderate and high stringency conditions can optionally be employed for sequences of greater identity. Low stringency conditions allow selective hybridization of sequences having about 70% to 80% sequence identity and can be employed to identify orthologous or paralogous sequences.

D. Polynucleotides Having a Specific Sequence Identity with the Polynucleotides of (A), (B) or (C)

As indicated in (d), above, the present invention provides isolated nucleic acids comprising polynucleotides of the present invention, wherein the polynucleotides have a specified identity at the nucleotide level to a polynucleotide as disclosed above in sections (A), (B), or (C), above. Identity can be calculated using, for example, the BLAST, CLUSTALW, or GAP algorithms under default conditions. The percentage of identity to a reference sequence is at least 60% and, rounded upwards to the nearest integer, can be expressed as an integer selected from the group of integers consisting of from 60 to 99. Thus, for example, the percentage of identity to a reference sequence can be at least 70%, 75%, 80%, 85%, 90%, or 95%. This same process may also be applied to the known CslA sequences disclosed herein and known in the art to identify other CslA proteins which will have xylan synthase activity.

Optionally, the polynucleotides of this embodiment will encode a polypeptide that will share an epitope with a polypeptide encoded by the polynucleotides of sections (A), (B), or (C). Thus, these polynucleotides encode a first polypeptide which elicits production of antisera comprising antibodies which are specifically reactive to a second polypeptide encoded by a polynucleotide of (A), (B), or (C). However, the first polypeptide does not bind to antisera raised against itself when the antisera has been fully immunosorbed with the first polypeptide. Hence, the polynucleotides of this embodiment can be used to generate antibodies for use in, for example, the screening of expression libraries for nucleic acids comprising polynucleotides of (A), (B), or (C), or for purification of, or in immunoassays for, polypeptides encoded by the polynucleotides of (A), (B), or (C). The polynucleotides of this embodiment comprise nucleic acid sequences which can be employed for selective hybridization to a polynucleotide encoding a polypeptide of the present invention.

Screening polypeptides for specific binding to antisera can be conveniently achieved using peptide display libraries. This method involves the screening of large collections of peptides for individual members having the desired function or structure.

Antibody screening of peptide display libraries is well known in the art. The displayed peptide sequences can be from 3 to 5000 or more amino acids in length, frequently from 5100 amino acids long, and often from about 8 to 15 amino acids long. In addition to direct chemical synthetic methods for generating peptide libraries, several recombinant DNA methods have been described. One type involves the display of a peptide sequence on the surface of a bacteriophage or cell. Each bacteriophage or cell contains the nucleotide sequence encoding the particular displayed peptide sequence. Such methods are described in PCT patent publication Nos. 91/17271, 91/18980, 91/19818, and 93/08278. Other systems for generating libraries of peptides have aspects of both in vitro chemical synthesis and recombinant methods. See, PCT Patent publication Nos. 92/05258, 92/14843, and 97/20078. See also, U.S. Pat. Nos. 5,658,754; and 5,643,768. Peptide display libraries, vectors, and screening kits are commercially available from such suppliers as Invitrogen (Carlsbad, Calif.).

E. Polynucleotides Encoding a Protein Having a Subsequence from a Prototype Polypeptide and Cross-Reactive to the Prototype Polypeptide As indicated in (e), above, the present invention provides isolated nucleic acids comprising the xylan synthase polynucleotides of the present invention, wherein the polynucleotides encode a protein having a subsequence of contiguous amino acids from a prototype polypeptide of the present invention such as are provided in (a), above. The length of contiguous amino acids from the prototype polypeptide is selected from the group of integers consisting of from at least 10 to the number of amino acids within the prototype sequence. Thus, for example, the polynucleotide can encode a polypeptide having a subsequence having at least 10, 15, 20, 25, 30, 35, 40, 45, or 50, contiguous amino acids from the prototype polypeptide. Further, the number of such subsequences encoded by a polynucleotide of the instant embodiment can be any integer selected from the group consisting of from 1 to 20, such as 2, 3, 4, or 5. The subsequences can be separated by any integer of nucleotides from 1 to the number of nucleotides in the sequence such as at least 5, 10, 15, 25, 50, 100, or 200 nucleotides. This same process may also be applied to the known CslA sequences disclosed herein and known in the art to identify other CslA proteins which will have xylan synthase activity.

The proteins encoded by xylan synthase polynucleotides of this embodiment, when presented as an immunogen, elicit the production of polyclonal antibodies which specifically bind to a prototype polypeptide such as but not limited to, a polypeptide encoded by the polynucleotide of (a) or (b), above. Generally, however, a protein encoded by a polynucleotide of this embodiment does not bind to antisera raised against the prototype polypeptide when the antisera has been fully immunosorbed with the prototype polypeptide. Methods of making and assaying for antibody binding specificity/affinity are well known in the art. Exemplary immunoassay formats include ELISA, competitive immunoassays, radioimmunoassays, Western blots, indirect immunofluorescent assays and the like.

In a preferred assay method, fully immunosorbed and pooled antisera which is elicited to the prototype polypeptide can be used in a competitive binding assay to test the protein. The concentration of the prototype polypeptide required to inhibit 50% of the binding of the antisera to the prototype polypeptide is determined. If the amount of the protein required to inhibit binding is less than twice the amount of the prototype protein, then the protein is said to specifically bind to the antisera elicited to the immunogen.

Accordingly, the proteins and methods of the present invention embrace allelic variants, conservatively modified variants, and minor recombinant modifications to a prototype polypeptide.

A xylan synthase encoding polynucleotide of the present invention optionally encodes a protein having a molecular weight as the non-glycosylated protein within 20% of the molecular weight of the full-length non-glycosylated polypeptides of the present invention. Molecular weight can be readily determined by SDS-PAGE under reducing conditions. Optionally, the molecular weight is within 15% of a full length polypeptide of the present invention, more preferably within 10% or 5%, and most preferably within 3%, 2%, or 1% of a full length polypeptide of the present invention. Optionally, the polynucleotides of this embodiment will encode a protein having a specific enzymatic activity at least 50%, 60%, 80%, or 90% of a cellular extract comprising the native, endogenous full-length polypeptide of the present invention.

Further, the proteins encoded by polynucleotides of this embodiment will optionally have a substantially similar affinity constant (Km) and/or catalytic activity (i.e., the microscopic rate constant, kcat) as the native endogenous, full-length protein. Those of skill in the art will recognize that kcat/Km value determines the specificity for competing substrates and is often referred to as the specificity constant. Proteins of this embodiment can have a kcat/Km value at least 10% of a full-length polypeptide of the present invention as determined using the endogenous substrate of that polypeptide. Optionally, the kcat/Km value will be at least 20%, 30%, 40%, 50%, and most preferably at least 60%, 70%, 80%, 90%, or 95% the kcat/Km value of the full-length polypeptide of the present invention.

Determination of kcat, Km, and kcat/Km can be determined by any number of means well known to those of skill in the art. For example, the initial rates (i.e., the first 5% or less of the reaction) can be determined using rapid mixing and sampling techniques (e.g., continuous-flow, stopped-flow, or rapid quenching techniques), flash photolysis, or relaxation methods (e.g., temperature jumps) in conjunction with such exemplary methods of measuring as spectrophotometry, spectrofluorimetry, nuclear magnetic resonance, or radioactive procedures. Kinetic values are conveniently obtained using a Lineweaver Burk or Eadie-Hofstee plot.

F. Polynucleotides Complementary to the Polynucleotides of (A)-(E)

As indicated in (f), above, the present invention provides isolated nucleic acids comprising polynucleotides complementary to the polynucleotides of paragraphs A-E, above. s those of skill in the art will recognize, complementary sequences base-pair throughout the entirety of their length with the polynucleotides of sections (A)-(E) (i.e., have 100% sequence identity over their entire length). Complementary bases associate through hydrogen bonding in double stranded nucleic acids. For example, the following base pairs are complementary: guanine and cytosine; adenine and thymine; and adenine and uracil. This same process may also be applied to the known CslA sequences disclosed herein and known in the art to identify other CslA proteins which will have xylan synthase activity.

G. Polynucleotides which are Subsequences of the Polynucleotides of (A)-(F)

As indicated in (g), above, the present invention provides isolated nucleic acids comprising polynucleotides which comprise at least 15 contiguous bases from the polynucleotides of sections (A) through (F) as discussed above. The length of the polynucleotide is given as an integer selected from the group consisting of from at least 15 to the length of the nucleic acid sequence from which the polynucleotide is a subsequence of. Thus, for example, polynucleotides of the present invention are inclusive of polynucleotides comprising at least 15, 20, 25, 30, 40, 50, 60, 75, or 100 contiguous nucleotides in length from the polynucleotides of (A)-(F). Optionally, the number of such subsequences encoded by a polynucleotide of the instant embodiment can be any integer selected from the group consisting of from 1 to 20, such as 2, 3, 4, or 5. The subsequences can be separated by any integer of nucleotides from 1 to the number of nucleotides in the sequence such as at least 5, 10, 15, 25, 50, 100, or 200 nucleotides. This same process may also be applied to the known CslA sequences disclosed herein and known in the art to identify other CslA proteins which will have xylan synthase activity.

Subsequences can be made by in vitro synthetic, in vitro biosynthetic, or in vivo recombinant methods. In optional embodiments, subsequences can be made by nucleic acid amplification. For example, nucleic acid primers will be constructed to selectively hybridize to a sequence (or its complement) within, or co-extensive with, the coding region.

The subsequences of the present invention can comprise structura libraries are known in the art and discussed briefly below. The cDNA library comprises at least 50% to 95% full-length sequences (for example, at least 50%, 60%, 70%, 80%, 90%, or 95% full-length sequences). The cDNA library can be constructed from a variety of tissues from a monocot or dicot at a variety of developmental stages. Exemplary species include maize, wheat, rice, canola, soybean, cotton, sorghum, sunflower, alfalfa, oats, sugar cane, millet, barley, and rice. Methods of selectively hybridizing, under selective hybridization conditions, a polynucleotide from a full-length enriched library to a polynucleotide of the present invention are known to those of ordinary skill in the art. Any number of stringency conditions can be employed to allow for selective hybridization. In optional embodiments, the stringency allows for selective hybridization of sequences having at least 70%, 75%, 80%, 85%, 90%, 95%, or 98% sequence identity over the length of the hybridized region. Full-length enriched cDNA libraries can be normalized to increase the representation of rare sequences.

H. Polynucleotide Products Made by a cDNA Isolation Process

As indicated in (I), above, the present invention provides an isolated polynucleotide made by the process of: 1) providing a full-length enriched nucleic acid library, 2) selectively hybridizing the polynucleotide to a polynucleotide of paragraphs (A), (B), (C), (D), (E), (F), (G, or (H) as discussed above, and thereby isolating the polynucleotide from the nucleic acid library. Full-length enriched nucleic acid libraries are constructed as discussed in paragraph (G) and below. Selective hybridization conditions are as discussed in paragraph (G). Nucleic acid purification procedures are well known in the art. This same process may also be applied to the known CslA sequences disclosed herein and known in the art to identify other CslA proteins which will have xylan synthase activity.

Purification can be conveniently accomplished using solid-phase methods; such methods are well known to those of skill in the art and kits are available from commercial suppliers such as Advanced Biotechnologies (Surrey, UK). For example, a polynucleotide of paragraphs (A)-(H) can be immobilized to a solid support such as a membrane, bead, or particle. See, e.g., U.S. Pat. No. 5,667,976. The polynucleotide product of the present process is selectively hybridized to an immobilized polynucleotide and the solid support is subsequently isolated from non-hybridized polynucleotides by methods including, but not limited to, centrifugation, magnetic separation, filtration, electrophoresis, and the like.

Construction of Nucleic Acids

The xylan synthase nucleic acids of the present invention can be made using (a) standard recombinant methods, (b) synthetic techniques, or combinations thereof. In some embodiments, the polynucleotides of the present invention will be cloned, amplified, or otherwise constructed from a monocot such as corn, rice, or wheat, or a dicot such as soybean.

The nucleic acids may conveniently comprise sequences in addition to a polynucleotide of the present invention. For example, a multi-cloning site comprising one or more endonuclease restriction sites may be inserted into the nucleic acid to aid in isolation of the polynucleotide. Also, translatable sequences may be inserted to aid in the isolation of the translated polynucleotide of the present invention. For example, a hexahistidine marker sequence provides a convenient means to purify the proteins of the present invention. A polynucleotide of the present invention can be attached to a vector, adapter, or linker for cloning and/or expression of a polynucleotide of the present invention. Additional sequences may be added to such cloning and/or expression sequences to optimize their function in cloning and/or expression, to aid in isolation of the polynucleotide, or to improve the introduction of the polynucleotide into a cell. Typically, the length of a nucleic acid of the present invention less the length of its polynucleotide of the present invention is less than 20 kilobase pairs, often less than 15 kb, and frequently less than 10 kb. Use of cloning vectors, expression vectors, adapters, and linkers is well known and extensively described in the art. For a description of various nucleic acids see, for example, Stratagene Cloning Systems, Catalogs 1999 (La Jolla, Calif.); and, Amersham Life Sciences, Inc, Catalog '99 (Arlington Heights, Ill.).

A. Recombinant Methods for Constructing Nucleic Acids

The xylan synthase and/or isolated xylan synthase nucleic acid compositions of this invention, such as RNA, cDNA, genomic DNA, or a hybrid thereof, can be obtained from plant biological sources using any number of cloning methodologies known to those of skill in the art. In some embodiments, oligonucleotide probes which selectively hybridize, under stringent conditions, to the polynucleotides of the present invention are used to identify the desired sequence in a cDNA or genomic DNA library. Isolation of RNA, and construction of cDNA and genomic libraries is well known to those of ordinary skill in the art. See, e.g., Plant Molecular Biology: A Laboratory Manual, Clark, Ed., Springer-Verlag, Berlin (1997); and, Current Protocols in Molecular Biology, Ausubel, et al., Eds., Greene Publishing and Wiley-Interscience, New York (1995).

A1. Full-Length Enriched cDNA Libraries

A number of cDNA synthesis protocols have been described which provide enriched full-length cDNA libraries. Enriched full-length cDNA libraries are constructed to comprise at least 60%, and more preferably at least 70%, 80%, 90% or 95% full-length inserts amongst clones containing inserts. The length of insert in such libraries can be at least 2, 3, 4, 5, 6, 7, 8, 9, 10 or more kilobase pairs. Vectors to accommodate inserts of these sizes are known in the art and available commercially. See, e.g., Stratagene's lambda ZAP Express (cDNA cloning vector with 0 to 12 kb cloning capacity). An exemplary method of constructing a greater than 95% pure full-length cDNA library is described by Carninci et al., Genomics, 37: 327-336 (1996). Other methods for producing full-length libraries are known in the art. See, e.g., Edery et al., Mol. Cell. Biol., 15(6):3363-3371 (1995); and, PCT Application WO96/34981.

A2. Normalized or Subtracted cDNA Libraries

A non-normalized cDNA library represents the mRNA population of the tissue it was made from. Since unique clones are out-numbered by clones derived from highly expressed genes their isolation can be laborious. Normalization of a cDNA library is the process of creating a library in which each clone is more equally represented. Construction of normalized libraries is described in Ko, Nucl. Acids. Res., 18(19):57055711 (1990); Patanjali et al., Proc. Natl. Acad. U.S.A., 88:1943-1947 (1991); U.S. Pat. Nos. 5,482,685, 5,482,845, and 5,637,685. In an exemplary method described by Soares et al., normalization resulted in reduction of the abundance of clones from a range of four orders of magnitude to a narrow range of only 1 order of magnitude. Proc. Natl. Acad. Sci. USA, 91: 9228-9232 (1994).

Subtracted cDNA libraries are another means to increase the proportion of less abundant cDNA species. In this procedure, cDNA prepared from one pool of mRNA is depleted of sequences present in a second pool of mRNA by hybridization. The cDNA:mRNA hybrids are removed and the remaining un-hybridized cDNA pool is enriched for sequences unique to that pool. See, Foote et al. in, Plant Molecular Biology: A Laboratory Manual, Clark, Ed., Springer-Verlag, Berlin (1997); Kho and Zarbl, Technique, 3 (2): 58-63 (1991); Sive and St. John, Nucl. Acids Res., 16 (22): 10937 (1988); Current Protocols in Molecular Biology, Ausubel, et al., Eds., Greene Publishing and Wiley-Interscience, New York (1995); and, Swaroop et al., Nucl. Acids Res., 19) 8): 1954 (1991). cDNA subtraction kits are commercially available. See, e.g., PCR-Select (Clontech, Palo Alto, Calif.).

To construct genomic libraries, large segments of genomic DNA are generated by fragmentation, e.g. using restriction endonucleases, and are ligated with vector DNA to form concatemers that can be packaged into the appropriate vector. Methodologies to accomplish these ends, and sequencing methods to verify the sequence of nucleic acids are well known in the art. Examples of appropriate molecular biological techniques and instructions sufficient to direct persons of skill through many construction, cloning, and screening methodologies are found in Sambrook, et al., Molecular Cloning: A Laboratory Manual, 2nd Ed., Cold Spring Harbor Laboratory Vols. 1-3 (1989), Methods in Enzymology, Vol. 152: Guide to Molecular Cloning Techniques, Berger and Kimmel, Eds., San Diego: Academic Press, Inc. (1987), Current Protocols in Molecular Biology, Ausubel, et al., Eds., Greene Publishing and Wiley-Interscience, New York (1995); Plant Molecular Biology: A Laboratory Manual, Clark, Ed., Springer-Verlag, Berlin (1997). Kits for construction of genomic libraries are also commercially available.

The cDNA or genomic library can be screened using a probe based upon the sequence of a polynucleotide of the present invention such as those disclosed herein. Probes may be used to hybridize with genomic DNA or cDNA sequences to isolate homologous genes in the same or different plant species. Those of skill in the art will appreciate that various degrees of stringency of hybridization can be employed in the assay; and either the hybridization or the wash medium can be stringent.

The nucleic acids of interest can also be amplified from nucleic acid samples using amplification techniques. For instance, polymerase chain reaction (PCR) technology can be used to amplify the sequences of polynucleotides of the present invention and related genes directly from genomic DNA or cDNA libraries. PCR and other in vitro amplification methods may also be useful, for example, to clone nucleic acid sequences that code for proteins to be expressed, to make nucleic acids to use as probes for detecting the presence of the desired mRNA in samples, for nucleic acid sequencing, or for other purposes. The T4 gene 32 protein (Boehringer Mannheim) can be used to improve yield of long PCR products.

PCR-based screening methods have been described. Wilfinger et al. describe a PCR-based method in which the longest cDNA is identified in the first step so that incomplete clones can be eliminated from study. BioTechniques, 22(3): 481-486 (1997). Such methods are particularly effective in combination with a full-length cDNA construction methodology, above.

B. Synthetic Methods for Constructing Nucleic Acids

The xylan synthase encoding and/or isolated xylan synthase encoding nucleic acids of the present invention can also be prepared by direct chemical synthesis by methods such as the phosphotriester method of Narang et al., Meth. Enzymol. 68:90-99 (1979); the phosphodiester method of Brown et al., Meth. Enzymol. 68:109-151 (1979); the diethylphosphoramidite method of Beaucage et al., Tetra. Lett. 22:1859-1862 (1981); the solid phase phosphoramidite triester method described by Beaucage and Caruthers, Tetra. Letts. 22 (20): 1859-1862 (1981), e.g., using an automated synthesizer, e.g., as described in Needham-VanDevanter et al., Nucleic Acids Res., 12: 6159-6168 (1984); and, the solid support method of U.S. Pat. No. 4,458,066. Chemical synthesis generally produces a single stranded oligonucleotide. This may be converted into double stranded DNA by hybridization with a complementary sequence, or by polymerization with a DNA polymerase using the single strand as a template. One of skill will recognize that while chemical synthesis of DNA is best employed for sequences of about 100 bases or less, longer sequences may be obtained by the ligation of shorter sequences.

Recombinant Expression Cassettes

The present invention further provides recombinant expression cassettes comprising a xylan synthase encoding nucleic acid of the present invention. A nucleic acid sequence coding for the desired polypeptide of the present invention, for example a cDNA or a genomic sequence encoding a full length polypeptide of the present invention, can be used to construct a recombinant expression cassette which can be introduced into the desired host cell. A recombinant expression cassette will typically comprise a polynucleotide of the present invention operably linked to transcriptional initiation regulatory sequences which will direct the transcription of the polynucleotide in the intended host cell, such as tissues of a transformed plant.

For example, plant expression vectors may include (1) a cloned plant gene under the transcriptional control of 5' and 3' regulatory sequences and (2) a dominant selectable marker. Such plant expression vectors may also contain, if desired, a promoter regulatory region (e.g., one conferring inducible or constitutive, environmentally- or developmentally-regulated, or cell- or tissue-specific/selective expression), a transcription initiation start site, a ribosome binding site, an RNA processing signal, a transcription termination site, and/or a polyadenylation signal.

A plant promoter fragment can be employed which will direct expression of a polynucleotide of the present invention in all tissues of a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of Agrobacterium tumefaciens, the ubiquitin 1 promoter, the Smas promoter, the cinnamyl alcohol dehydrogenase promoter (U.S. Pat. No. 5,683,439), the Nos promoter, the pEmu promoter, the rubisco promoter, the GRP1-8 promoter, and other transcription initiation regions from various plant genes known to those of skill.

Alternatively, the plant promoter can direct expression of a polynucleotide of the present invention in a specific tissue or may be otherwise under more precise environmental or developmental control. Such promoters are referred to here as "inducible" promoters. Environmental conditions that may effect transcription by inducible promoters include pathogen attack, anaerobic conditions, or the presence of light. Examples of inducible promoters are the Adhl promoter which is inducible by hypoxia or cold stress, the Hsp70 promoter which is inducible by heat stress, and the PPDK promoter which is inducible by light.

Examples of promoters under developmental control include promoters that initiate transcription only, or preferentially, in certain tissues, such as leaves, roots, fruit, seeds, or flowers. Exemplary promoters include the anther specific promoter 5126 (U.S. Pat. Nos. 5,689,049 and 5,689,051), glob-1 promoter, and gamma-zein promoter. The operation of a promoter may also vary depending on its location in the genome. Thus, an inducible promoter may become fully or partially constitutive in certain locations.

Both heterologous and non-heterologous (i.e., endogenous) promoters can be employed to direct expression of the nucleic acids of the present invention. These promoters can also be used, for example, in recombinant expression cassettes to drive expression of antisense nucleic acids to reduce, increase, or alter concentration and/or composition of the proteins of the present invention in a desired tissue. Thus, in some embodiments, the nucleic acid construct will comprise a promoter functional in a plant cell, such as in Zea mays, operably linked to a polynucleotide of the present invention. Promoters useful in these embodiments include the endogenous promoters driving expression of a polypeptide of the present invention.

In some embodiments, isolated nucleic acids which serve as promoter or enhancer elements can be introduced in the appropriate position (generally upstream) of a non-heterologous form of a polynucleotide of the present invention so as to up or down regulate expression of a polynucleotide of the present invention. For example, endogenous promoters can be altered in vivo by mutation, deletion, and/or substitution (see, Kmiec, U.S. Pat. No. 5,565,350; Zarling et al., PCT/US93/03868), or isolated promoters can be introduced into a plant cell in the proper orientation and distance from a gene of the present invention so as to control the expression of the gene. Gene expression can be modulated under conditions suitable for plant growth so as to alter the total concentration and/or alter the composition of the polypeptides of the present invention in plant cell.

Thus, the present invention provides compositions, and methods for making, heterologous promoters and/or enhancers operably linked to a native, endogenous (i.e., nonheterologous) form of a polynucleotide of the present invention.

Methods for identifying promoters with a particular expression pattern, in terms of, e.g., tissue type, cell type, stage of development, and/or environmental conditions, are well known in the art. See, e.g., The Maize Handbook, Chapters 114-115, Freeling and Walbot, Eds., Springer, New York (1994); Corn and Corn Improvement, 3rd edition, Chapter 6, Sprague and Dudley, Eds., American Society of Agronomy, Madison, Wis. (1988).

A typical step in promoter isolation methods is identification of gene products that are expressed with some degree of specificity in the target tissue. Amongst the range of methodologies are: differential hybridization to cDNA libraries; subtractive hybridization; differential display; differential 2-D protein gel electrophoresis; DNA probe arrays; and isolation of proteins known to be expressed with some specificity in the target tissue. Such methods are well known to those of skill in the art. Commercially available products for identifying promoters are known in the art such as Clontech's (Palo Alto, Calif.) Universal Genome Walker Kit.

For the protein-based methods, it is helpful to obtain the amino acid sequence for at least a portion of the identified protein, and then to use the protein sequence as the basis for preparing a nucleic acid that can be used as a probe to identify either genomic DNA directly, or preferably, to identify a cDNA clone from a library prepared from the target tissue. Once such a cDNA clone has been identified, that sequence can be used to identify the sequence at the 5' end of the transcript of the indicated gene. For differential hybridization, subtractive hybridization and differential display, the nucleic acid sequence identified as enriched in the target tissue is used to identify the sequence at the 5' end of the transcript of the indicated gene. Once such sequences are identified, starting either from protein sequences or nucleic acid sequences, any of these sequences identified as being from the gene transcript can be used to screen a genomic library prepared from the target organism. Methods for identifying and confirming the transcriptional start site are well known in the art.

In the process of isolating promoters expressed under particular environmental conditions or stresses, or in specific tissues, or at particular developmental stages, a number of genes are identified that are expressed under the desired circumstances, in the desired tissue, or at the desired stage. Further analysis will reveal expression of each particular gene in one or more other tissues of the plant. One can identify a promoter with activity in the desired tissue or condition but that does not have activity in any other common tissue.

To identify the promoter sequence, the 5' portions of the clones described here are analyzed for sequences characteristic of promoter sequences. For instance, promoter sequence elements include the TATA box consensus sequence (TATAAT), which is usually an AT-rich stretch of 5-10 bp located approximately 20 to 40 base pairs upstream of the transcription start site. Identification of the TATA box is well known in the art. For example, one way to predict the location of this element is to identify the transcription start site using standard RNA-mapping techniques such as primer extension, S1 analysis, and/or RNase protection. To confirm the presence of the AT-rich sequence, a structure-function analysis can be performed involving mutagenesis of the putative region and quantification of the mutation's effect on expression of a linked downstream reporter gene. See, e.g., The Maize Handbook, Chapter 114, Freeling and Walbot, Eds., Springer, New York, (1994).

In plants, further upstream from the TATA box, at positions −80 to −100, there is typically a promoter element (i.e., the CAAT box) with a series of adenines surrounding the trinucleotide G (or T) N G. J. Messing et al., in Genetic Engineering in Plants, Kosage, Meredith and Hollaender, Eds., pp. 221-227 1983. In maize, there is no well conserved CAAT box but there are several short, conserved protein-binding motifs upstream of the TATA box. These include motifs for the trans-acting transcription factors involved in light regulation, anaerobic induction, hormonal regulation, or anthocyanin biosynthesis, as appropriate for each gene.

Once promoter and/or gene sequences are known, a region of suitable size is selected from the genomic DNA that is 5' to the transcriptional start, or the translational start site, and such sequences are then linked to a coding sequence. If the transcriptional start site is used as the point of fusion, any of a number of possible 5' untranslated regions can be used in between the transcriptional start site and the partial coding sequence. If the translational start site at the 3' end of the specific promoter is used, then it is linked directly to the methionine start codon of a coding sequence.

If polypeptide expression is desired, it is generally desirable to include a polyadenylation region at the 3' end of a polynucleotide coding region. The polyadenylation region can be derived from the natural gene, from a variety of other plant genes, or from T-DNA. The 3' end sequence to be added can be derived from, for example, the nopaline synthase or octopine synthase genes, or alternatively from another plant gene, or less preferably from any other eukaryotic gene.

An intron sequence can be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold. Buchman and Berg, Mol. Cell. Biol. 8: 43954405 (1988); Callis et al., Genes Dev. 1:1183-1200 (1987). Such intron enhancement of gene expression is typically greatest when placed near the 5' end of the transcription unit. Use of maize introns Adhl-S intron 1,2, and 6, the Bronze-1 intron are known in the art. See generally, The Maize Handbook, Chapter 116, Freeling and Walbot, Eds., Springer, New York (1994).

The vector comprising the sequences from a polynucleotide of the present invention will typically comprise a marker gene which confers a selectable phenotype on plant cells. Usually, the selectable marker gene will encode antibiotic resistance, with suitable genes including genes coding for resistance to the antibiotic spectinomycin (e.g., the aada gene), the streptomycin phosphotransferase (SPT) gene coding for streptomycin resistance, the neomycin phosphotransferase (NPTII) gene encoding kanamycin or genetic in resistance, the hygromycin phosphotransferase (HPT) gene coding for hygromycin resistance, genes coding for resistance to herbicides which act to inhibit the action of acetolactate synthase (ALS), in particular the sulfonylurea-type herbicides (e.g., the acetolactate synthase (ALS) gene containing mutations leading to such resistance in particular the S4 and/or Hra mutations), genes coding for resistance to herbicides which act to inhibit action of glutamine synthase, such as phosphinothricin or basta (e.g., the bar gene), or other such genes known in the art. The bar gene encodes resistance to the herbicide basta, the nptII gene encodes resistance to the antibiotic kanamycin, and the ALS gene encodes resistance to the herbicide chlorsulfuron.

Typical vectors useful for expression of genes in higher plants are well known in the art and include vectors derived from the tumor-inducing (Ti) plasmid of *Agrobacterium tumefaciens* described by Rogers et al., Meth. in Enzymol., 153:253-277 (1987). These vectors are plant integrating vectors in that on transformation, the vectors integrate a portion of vector DNA into the genome of the host plant. Exemplary *A. tumefaciens* vectors useful herein are plasmids pKYLX6 and pKYLX7 of Schardl et al., Gene, 61: 1-11 (1987) and Berger et al., Proc. Natl. Acad. Sci. U.S.A., 86: 8402-8406 (1989). Another useful vector herein is plasmid pBI101.2 that is available from Clontech Laboratories, Inc. (Palo Alto, Calif.).

A polynucleotide of the present invention can be expressed in either sense or antisense orientation as desired. It will be appreciated that control of gene expression in either sense or anti-sense orientation can have a direct impact on the observable plant characteristics. Antisense technology can be conveniently used to inhibit gene expression in plants. To accomplish this, a nucleic acid segment from the desired gene is cloned and operably linked to a promoter such that the antisense strand of RNA will be transcribed. The construct is then transformed into plants and the antisense strand of RNA is produced.

In plant cells, it has been shown that antisense RNA inhibits gene expression by preventing the accumulation of mRNA which encodes the enzyme of interest, see, e.g., Sheehy et al., Proc. Nat'l. Acad. Sci. (USA) 85: 8805-8809 (1988); and Hiatt et al., U.S. Pat. No. 4,801,340.

Another method of suppression is sense suppression. Introduction of nucleic acid configured in the sense orientation has been shown to be an effective means by which to block the transcription of target genes. For an example of the use of this method to modulate expression of endogenous genes see, Napoli et al., The Plant Cell 2:279-289 (1990) and U.S. Pat. No. 5,034,323.

Catalytic RNA molecules or ribozymes can also be used to inhibit expression of plant genes. It is possible to design ribozymes that specifically pair with virtually any target RNA and cleave the phosphodiester backbone at a specific location, thereby functionally inactivating the target RNA. In carrying out this cleavage, the ribozyme is not itself altered, and is thus capable of recycling and cleaving other molecules, making it a true enzyme. The inclusion of ribozyme sequences within antisense RNAs confers RNA cleaving activity upon them, thereby increasing the activity of the constructs. The design and use of target RNA-specific ribozymes is described in Haseloff et al., Nature 334: 585 591 (1988). A variety of cross-linking agents, alkylating agents and radical generating species as pendant groups on polynucleotides of the present invention can be used to bind, label, detect, and/or cleave nucleic acids. For example, Vlassov, V. V., et al., Nucleic Acids Res (1986) 14: 4065-4076, describe covalent bonding of a single-stranded DNA fragment with alkylating derivatives of nucleotides complementary to target sequences. A report of similar work by the same group is that by Knorre, D. G., et al., Biochimie (1985) 67: 785 789. Iverson and Dervan.

The present invention further provides a protein comprising a polypeptide having a specified sequence identity with a polypeptide of the present invention. The percentage of sequence identity is an integer selected from the group consisting of from 60 to 99. Exemplary sequence identity values include 60%, 65%, 70%, 75%, 80%, 85%, 90%, and 95%.

As those of skill will appreciate, the present invention includes catalytically active polypeptides of the present invention (i.e., enzymes). Catalytically active polypeptides have a specific activity of at least 20%, 30%, or 40%, and preferably at least 50%, 60%, or 70%, and most preferably at least 80%, 90%, or 95% that of the native (non-synthetic), endogenous polypeptide. Further, the substrate specificity (kcat/Km) is optionally substantially similar to the native (non-synthetic), endogenous polypeptide. Typically, the Km will be at least 30%, 40%, or 50%, that of the native (non-synthetic), endogenous polypeptide; and more preferably at least 60%, 70%, 80%, or 90%. Methods of assaying and quantifying measures of enzymatic activity and substrate specificity (heat/Km), are well known to those of skill in the art.

Generally, the proteins of the present invention will, when presented as an immunogen, elicit production of an antibody specifically reactive to a polypeptide of the present invention. Further, the proteins of the present invention will not bind to antisera raised against a polypeptide of the present invention which has been fully immunosorbed with the same polypeptide. Immunoassays for determining binding are well known to those of skill in the art. A preferred immunoassay is a competitive immunoassay as discussed, infra. Thus, the proteins of the present invention can be employed as immunogens for constructing antibodies immunoreactive to a protein of the present invention for such exemplary utilities as immunoassays or protein purification techniques.

Expression of Proteins in Host Cells

Using the nucleic acids of the present invention, one may express a protein of the present invention in a recombinantly engineered cell such as bacteria, yeast, insect, mammalian, or preferably plant cells. The cells produce the protein in a non-natural condition (e.g., in quantity, composition, location, and/or time), because they have been genetically altered through human intervention to do so.

It is expected that those of skill in the art are knowledgeable in the numerous expression systems available for expression of a nucleic acid encoding a protein of the present invention. No attempt to describe in detail the various methods known for the expression of proteins in prokaryotes or eukaryotes will be made.

In brief summary, the expression of isolated nucleic acids encoding a protein of the present invention will typically be achieved by operably linking, for example, the DNA or cDNA to a promoter (which is either constitutive or regulatable), followed by incorporation into an expression vector. The vectors can be suitable for replication and integration in either prokaryotes or eukaryotes. Typical expression vectors contain transcription and translation terminators, initiation sequences, and promoters useful for regulation of the expression of the DNA encoding a protein of the present invention. To obtain high level expression of a cloned gene, it is desirable to construct expression vectors which contain, at the minimum, a strong promoter to direct transcription, a ribosome binding site for translational initiation, and a transcription/translation terminator. One of skill would recognize that modifications can be made to a protein of the present invention without diminishing its biological activity. Some modifications may be made to facilitate the cloning, expression, or incorporation of the targeting molecule into a fusion protein.

Such modifications are well known to those of skill in the art and include, for example, a methionine added at the amino terminus to provide an initiation site, or additional amino acids (e.g., poly His) placed on either terminus to create conveniently located purification sequences. Restriction sites or termination codons can also be introduced.

A. Expression in Prokaryotes Prokaryotic cells may be used as hosts for expression. Prokaryotes most frequently are represented by various strains of *E. coli*; however, other microbial strains may also be used. Commonly used prokaryotic control sequences which are defined herein to include promoters for transcription initiation, optionally with an operator, along with ribosome binding site sequences, include such commonly used promoters as the beta lactamase (penicillinase) and lactose (lac) promoter systems (Chang et al., Nature 198: 1056 (1977)), the tryptophan (trp) promoter system (Goeddel et al., NucleicAcids Res. 8: 4057 (1980)) and the lambda derived P L promoter and N-gene ribosome binding site (Shimatake et al., Nature 292: 128 (1981)). The inclusion of selection markers in DNA vectors transfected in *E. coli* is also useful. Examples of such markers include genes specifying resistance to ampicillin, tetracycline, or chloramphenicol.

The vector is selected to allow introduction into the appropriate host cell. Bacterial vectors are typically of plasmid or phage origin. Appropriate bacterial cells are infected with phage vector particles or transfected with naked phage vector DNA. If a plasmid vector is used, the bacterial cells are transfected with the plasmid vector DNA. Expression systems for expressing a protein of the present invention are available using *Bacillus* sp. and *Salmonella* (Palva, et al., Gene 22: 229-235 (1983); Mosbach, et al., Nature 302:543545 (1983)).

B. Expression in Eukaryotes

A variety of eukaryotic expression systems such as yeast, insect cell lines, plant and mammalian cells, are known to those of skill in the art. As explained briefly below, a polynucleotide of the present invention can be expressed in these eukaryotic systems. In some embodiments, transformed/transfected plant cells, as discussed infra, are employed as expression systems for production of the proteins of the instant invention.

Synthesis of heterologous proteins in yeast is well known. Sherman, F., et al., Methods in Yeast Genetics, Cold Spring Harbor Laboratory (1982) is a well recognized work describing the various methods available to produce the protein in yeast. Two widely utilized yeast for production of eukaryotic proteins are *Saccharomyces cerevisiae* and *Pichia pastoris*. Vectors, strains, and protocols for expression in *Saccharomyces* and *Pichia* are known in the art and available from commercial suppliers (e.g., Invitrogen).

Suitable vectors usually have expression control sequences, such as promoters, including 3-phosphoglycerate kinase or alcohol oxidase, and an origin of replication, termination sequences and the like as desired.

A protein of the present invention, once expressed, can be isolated from yeast by lysing the cells and applying standard protein isolation techniques to the lysate. The monitoring of the purification process can be accomplished by using Western blot techniques or radioimmunoassay or other standard immunoassay techniques.

The sequences encoding proteins of the present invention can also be ligated to various expression vectors for use in transfecting cell cultures of, for instance, mammalian, insect, or plant origin. Illustrative of cell cultures useful for the production of the peptides are mammalian cells. Mammalian cell systems often will be in the form of monolayers of cells although mammalian cell suspensions may also be used. A number of suitable host cell lines capable of expressing intact proteins have been developed in the art, and include the HEK293, BHK21, and CHO cell lines. Expression vectors for these cells can include expression control sequences, such as an origin of replication, a promoter (e.g., the CMV promoter, a HSVtk promoter or pgk (phosphoglycerate kinase) promoter), an enhancer (Queen et al., Immunol. Rev. 89: 49 (1986)), and necessary processing information sites, such as ribosome binding sites, RNA splice sites, polyadenylation sites (e.g., an SV40 large T Ag poly A addition site), and transcriptional terminator sequences. Other animal cells useful for production of proteins of the present invention are available, for instance, from the American Type Culture Collection.

Appropriate vectors for expressing proteins of the present invention in insect cells are usually derived from the SF9 baculovirus. Suitable insect cell lines include mosquito larvae, silkworm, army worm, moth and *Drosophila* cell lines such as a Schneider cell line (See, Schneider, J. Embryol. Exp. Morphol. 27: 353-365 (1987).

As with yeast, when higher animal or plant host cells are employed, polyadenylation or transcription terminator sequences are typically incorporated into the vector. An example of a terminator sequence is the polyadenylation sequence from the bovine growth hormone gene. Sequences for accurate splicing of the transcript may also be included. An example of a splicing sequence is the VP1 intron from SV40 (Sprague, et al., J. Virol. 45: 773-781 (1983)). Additionally, gene sequences to control replication in the host cell may be incorporated into the vector such as those found in bovine papilloma virus type-vectors. Saveria-Campo, M., Bovine Papilloma Virus DNA a Eukaryotic Cloning Vector in DNA Cloning Vol. II a Practical Approach, D. M. Glover, Ed., IRL Press, Arlington, Va. pp. 213-238 (1985).

Increasing the Activity and/or Level of a Xylan Synthase Polypeptide

Methods are provided to increase the activity and/or level of the xylan synthase polypeptide of the invention. An increase in the level and/or activity of the xylan synthase polypeptide of the invention can be achieved by providing to the plant an xylan synthase polypeptide. The xylan synthase polypeptide can be provided by introducing the amino acid sequence encoding the xylan synthase polypeptide into the plant, introducing into the plant a nucleotide sequence encoding an xylan synthase polypeptide or alternatively by modifying a genomic locus encoding the xylan synthase polypeptide of the invention.

As discussed elsewhere herein, many methods are known in the art for providing a polypeptide to a plant including, but not limited to, direct introduction of the polypeptide into the plant or introducing into the plant (transiently or stably) a polynucleotide construct encoding a polypeptide having enhanced activity. It is also recognized that the methods of the invention may employ a polynucleotide that is not capable of directing, in the transformed plant, the expression of a protein or an RNA. Thus, the level and/or activity of an xylan synthase polypeptide may be increased by altering the gene encoding the xylan synthase polypeptide or its promoter. See, e.g., Kmiec, U.S. Pat. No. 5,565,350; Zarling, et al., PCT/US93/03868. Therefore mutagenized plants that carry mutations in xylan synthase genes, where the mutations increase expression of the xylan synthase gene or increase the xylan synthase activity of the encoded xylan synthase polypeptide are provided.

Reducing the Activity and/or Level of an Xylan Synthase Polypeptide

Methods are provided to reduce or eliminate the activity of an xylan synthase polypeptide of the invention by transforming a plant cell with an expression cassette that expresses a polynucleotide that inhibits the expression of the xylan synthase polypeptide. The polynucleotide may inhibit the expression of the xylan synthase polypeptide directly, by preventing transcription or translation of the xylan synthase messenger RNA, or indirectly, by encoding a polypeptide that inhibits the transcription or translation of an xylan synthase gene encoding xylan synthase polypeptide. Methods for inhibiting or eliminating the expression of a gene in a plant are well known in the art, and any such method may be used in the present invention to inhibit the expression of xylan synthase polypeptide.

In accordance with the present invention, the expression of an xylan synthase polypeptide is inhibited if the protein level of the xylan synthase polypeptide is less than 70% of the protein level of the same xylan synthase polypeptide in a plant that has not been genetically modified or mutagenized to inhibit the expression of that xylan synthase polypeptide. In particular embodiments of the invention, the protein level of the xylan synthase polypeptide in a modified plant according to the invention is less than 60%, less than 50%, less than 40%, less than 30%, less than 20%, less than 10%, less than 5%, or less than 2% of the protein level of the same xylan synthase polypeptide in a plant that is not a mutant or that has not been genetically modified to inhibit the expression of that xylan synthase polypeptide. The expression level of the xylan synthase polypeptide may be measured directly, for example, by assaying for the level of xylan synthase polypeptide expressed in the plant cell or plant, or indirectly, for example, by measuring the xylose levels the plant cell or plant, or by measuring the phenotypic changes in the plant. Methods for performing such assays are described elsewhere herein.

In other embodiments of the invention, the activity of the xylan synthase polypeptide is reduced or eliminated by transforming a plant cell with an expression cassette comprising a polynucleotide encoding a polypeptide that inhibits the activity of an xylan synthase polypeptide. The activity of an xylan synthase polypeptide is inhibited according to the present invention if the activity of the xylan synthase polypeptide is less than 70% of the activity of the same xylan synthase polypeptide in a plant that has not been modified to inhibit the xylan synthase activity of that polypeptide. In particular embodiments of the invention, the xylan synthase activity of the xylan synthase polypeptide in a modified plant according to the invention is less than 60%, less than 50%, less than 40%, less than 30%, less than 20%, less than 10%, or less than 5% of the xylan synthase activity of the same polypeptide in a plant that that has not been modified to inhibit the expression of that xylan synthase polypeptide. The xylan synthase activity of an xylan synthase polypeptide is "eliminated" according to the invention when it is not detectable by the assay methods described elsewhere herein. Methods of determining the alteration of activity of an xylan synthase polypeptide are described elsewhere herein.

In other embodiments, the activity of an xylan synthase polypeptide may be reduced or eliminated by disrupting the gene encoding the xylan synthase polypeptide. The invention encompasses mutagenized plants that carry mutations in xylan synthase genes, where the mutations reduce expression of the xylan synthase gene or inhibit the activity of the encoded xylan synthase polypeptide.

Thus, many methods may be used to reduce or eliminate the activity of an xylan synthase polypeptide. In addition, more than one method may be used to reduce the activity of a single xylan synthase polypeptide.

1. Polynucleotide-Based Methods:

In some embodiments of the present invention, a plant is transformed with an expression cassette that is capable of expressing a polynucleotide that inhibits the expression of an xylan synthase polypeptide of the invention. The term "expression" as used herein refers to the biosynthesis of a gene product, including the transcription and/or translation of said gene product. For example, for the purposes of the present invention, an expression cassette capable of expressing a polynucleotide that inhibits the expression of at least one xylan synthase polypeptide is an expression cassette capable of producing an RNA molecule that inhibits the transcription and/or translation of at least one xylan synthase polypeptide of the invention. The "expression" or "production" of a protein or polypeptide from a DNA molecule refers to the transcription and translation of the coding sequence to produce the protein or polypeptide, while the "expression" or "production" of a protein or polypeptide from an RNA molecule refers to the translation of the RNA coding sequence to produce the protein or polypeptide.

Examples of polynucleotides that inhibit the expression of an xylan synthase polypeptide are given below.

i. Sense Suppression/Cosuppression

In some embodiments of the invention, inhibition of the expression of an xylan synthase polypeptide may be obtained by sense suppression or cosuppression. For cosuppression, an expression cassette is designed to express an RNA molecule corresponding to all or part of a messenger RNA encoding an xylan synthase polypeptide in the "sense" orientation. Over expression of the RNA molecule can result in reduced expression of the native gene. Accordingly, multiple plant lines transformed with the cosuppression expression cassette are screened to identify those that show the greatest inhibition of xylan synthase polypeptide expression.

The polynucleotide used for cosuppression may correspond to all or part of the sequence encoding the xylan synthase polypeptide, all or part of the 5' and/or 3' untranslated region of an xylan synthase polypeptide transcript, or all or part of both the coding sequence and the untranslated regions of a transcript encoding an xylan synthase polypeptide. In some embodiments where the polynucleotide comprises all or part of the coding region for the xylan synthase polypeptide, the expression cassette is designed to eliminate the start codon of the polynucleotide so that no protein product will be translated.

Cosuppression may be used to inhibit the expression of plant genes to produce plants having undetectable protein levels for the proteins encoded by these genes. See, for example, Broin, et al., (2002) *Plant Cell* 14:1417-1432. Cosuppression may also be used to inhibit the expression of multiple proteins in the same plant. See, for example, U.S. Pat. No. 5,942,657. Methods for using cosuppression to inhibit the expression of endogenous genes in plants are described in Flavell, et al., (1994) *Proc. Natl. Acad. Sci. USA* 91:3490-3496; Jorgensen, et al., (1996) *Plant Mol. Biol.* 31:957-973; Johansen and Carrington, (2001) *Plant Physiol.* 126:930-938; Broin, et al., (2002) *Plant Cell* 14:1417-1432; Stoutjesdijk, et al., (2002) *Plant Physiol.* 129:1723-1731; Yu, et al., (2003) *Phytochemistry* 63:753-763; and U.S. Pat. Nos. 5,034,323, 5,283,184, and 5,942,657; each of which is herein incorporated by reference. The efficiency of cosuppression may be increased by including a poly-dT region in the expression cassette at a position 3' to the sense sequence and 5' of the polyadenylation signal. See, U.S. Patent Publication No. 20020048814, herein incorporated by reference. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity. See U.S. Pat. Nos. 5,283,184 and 5,034,323; herein incorporated by reference.

ii. Antisense Suppression

In some embodiments of the invention, inhibition of the expression of the xylan synthase polypeptide may be obtained by antisense suppression. For antisense suppression, the expression cassette is designed to express an RNA molecule complementary to all or part of a messenger RNA encoding the xylan synthase polypeptide. Over expression of the antisense RNA molecule can result in reduced expression of the native gene. Accordingly, multiple plant lines transformed with the antisense suppression expression cassette are screened to identify those that show the greatest inhibition of xylan synthase polypeptide expression.

The polynucleotide for use in antisense suppression may correspond to all or part of the complement of the sequence encoding the xylan synthase polypeptide, all or part of the complement of the 5' and/or 3' untranslated region of the xylan synthase transcript, or all or part of the complement of both the coding sequence and the untranslated regions of a transcript encoding the xylan synthase polypeptide. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. See, for example, U.S. Pat. No. 5,942,657. Furthermore, portions of the antisense nucleotides may be used to disrupt the expression of the target gene. Generally, sequences of at least 50 nucleotides, 100 nucleotides, 200 nucleotides, 300, 400, 450, 500, 550, or greater may be used. Methods for using antisense suppression to inhibit the expression of endogenous genes in plants are described, for example, in Liu, et al., (2002) *Plant Physiol.* 129:1732-1743 and U.S. Pat. Nos. 5,759,829 and 5,942,657, each of which is herein incorporated by reference. Efficiency of antisense suppression may be increased by including a poly-dT region in the expression cassette at a position 3' to the antisense sequence and 5' of the polyadenylation signal. See, U.S. Patent Publication No. 2002/0048814, herein incorporated by reference.

iii. Double-Stranded RNA Interference

In some embodiments of the invention, inhibition of the expression of an xylan synthase polypeptide may be obtained by double-stranded RNA (dsRNA) interference. For dsRNA interference, a sense RNA molecule like that described above for cosuppression and an antisense RNA molecule that is fully or partially complementary to the sense RNA molecule are expressed in the same cell, resulting in inhibition of the expression of the corresponding endogenous messenger RNA.

Expression of the sense and antisense molecules can be accomplished by designing the expression cassette to comprise both a sense sequence and an antisense sequence. Alternatively, separate expression cassettes may be used for the sense and antisense sequences. Multiple plant lines transformed with the dsRNA interference expression cassette or expression cassettes are then screened to identify plant lines that show the greatest inhibition of xylan synthase polypeptide expression. Methods for using dsRNA interference to inhibit the expression of endogenous plant genes are described in Waterhouse, et al., (1998) *Proc. Natl. Acad. Sci. USA* 95:13959-13964, Liu, et al., (2002) *Plant Physiol.* 129: 1732-1743, and WO 99/49029, WO 99/53050, WO 99/61631, and WO 00/49035; each of which is herein incorporated by reference.

iv. Hairpin RNA Interference and Intron-Containing Hairpin RNA Interference

In some embodiments of the invention, inhibition of the expression of an xylan synthase polypeptide may be obtained by hairpin RNA (hpRNA) interference or intron-containing hairpin RNA (ihpRNA) interference. These methods are highly efficient at inhibiting the expression of endogenous genes. See, Waterhouse and Helliwell, (2003) *Nat. Rev. Genet.* 4:29-38 and the references cited therein.

For hpRNA interference, the expression cassette is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited, and an antisense sequence that is fully or partially complementary to the sense sequence. Alternatively, the base-paired stem region may correspond to a portion of a promoter sequence controlling expression of the gene to be inhibited. Thus, the base-paired stem region of the molecule generally determines the specificity of the RNA interference. hpRNA molecules are highly efficient at inhibiting the expression of endogenous genes, and the RNA interference they induce is inherited by subsequent generations of plants. See, for example, Chuang and Meyerowitz, (2000) *Proc. Natl. Acad. Sci. USA* 97:4985-4990; Stoutjesdijk, et al., (2002) *Plant Physiol.* 129:1723-1731; and Waterhouse and Helliwell, (2003) *Nat. Rev. Genet.* 4:29-38. Methods for using hpRNA interference to inhibit or silence the expression of genes are described, for example, in Chuang and Meyerowitz, (2000) *Proc. Natl. Acad. Sci. USA* 97:4985-4990; Stoutjesdijk, et al., (2002) *Plant Physiol.* 129: 1723-1731; Waterhouse and Helliwell, (2003) *Nat. Rev. Genet.* 4:29-38; Pandolfini et al., *BMC Biotechnology* 3:7, and U.S. Patent Publication No. 2003/0175965; each of which is herein incorporated by reference. A transient assay for the efficiency of hpRNA constructs to silence gene expression in vivo has been described by Panstruga, et al., (2003) *Mol. Biol. Rep.* 30:135-140, herein incorporated by reference.

For ihpRNA, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) *Nature* 407: 319-320. In fact, Smith, et al., show 100% suppression of endogenous gene expression using ihpRNA-mediated interference. Methods for using ihpRNA interference to inhibit the expression of endogenous plant genes are described, for example, in Smith, et al., (2000) *Nature* 407:319-320; Wesley, et al., (2001) *Plant J.* 27:581-590; Wang and Waterhouse, (2001) *Curr. Opin. Plant Biol.* 5:146-150; Waterhouse and Helliwell, (2003) *Nat. Rev. Genet.* 4:29-38; Helliwell and Waterhouse, (2003) *Methods* 30:289-295, and U.S. Patent Publication No. 2003/0180945, each of which is herein incorporated by reference.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 02/00904; Mette, et al., (2000) *EMBO J.* 19:5194-5201; Matzke, et al., (2001)*Curr. Opin. Genet. Devel.* 11:221-227; Scheid, et al., (2002) *Proc. Natl. Acad. Sci., USA* 99:13659-13662; Aufsaftz, et al., (2002) *Proc. Nat'l. Acad. Sci.* 99(4): 16499-16506; Sijen, et al., *Curr. Biol.* (2001) 11:436-440), herein incorporated by reference.

v. Amplicon-Mediated Interference

Amplicon expression cassettes comprise a plant virus-derived sequence that contains all or part of the target gene but generally not all of the genes of the native virus. The viral sequences present in the transcription product of the expression cassette allow the transcription product to direct its own replication. The transcripts produced by the amplicon may be either sense or antisense relative to the target sequence (i.e., the messenger RNA for the xylan synthase polypeptide). Methods of using amplicons to inhibit the expression of endogenous plant genes are described, for example, in Angell and Baulcombe, (1997) *EMBO J.* 16:3675-3684, Angell and Baulcombe, (1999) *Plant J.* 20:357-362, and U.S. Pat. No. 6,646,805, each of which is herein incorporated by reference.

vi. Ribozymes

In some embodiments, the polynucleotide expressed by the expression cassette of the invention is catalytic RNA or has ribozyme activity specific for the messenger RNA of the xylan synthase polypeptide. Thus, the polynucleotide causes the degradation of the endogenous messenger RNA, resulting in reduced expression of the xylan synthase polypeptide. This method is described, for example, in U.S. Pat. No. 4,987,071, herein incorporated by reference.

vii. Small Interfering RNA or Micro RNA

In some embodiments of the invention, inhibition of the expression of an xylan synthase polypeptide may be obtained by RNA interference by expression of a gene encoding a micro RNA (miRNA). miRNAs are regulatory agents consisting of about 22 ribonucleotides. miRNA are highly efficient at inhibiting the expression of endogenous genes. See, for example Javier, et al., (2003)*Nature* 425:257-263, herein incorporated by reference.

For miRNA interference, the expression cassette is designed to express an RNA molecule that is modeled on an endogenous miRNA gene. The miRNA gene encodes an RNA that forms a hairpin structure containing a 22-nucleotide sequence that is complementary to another endogenous gene (target sequence). For suppression of xylan synthase expression, the 22-nucleotide sequence is selected from an xylan synthase transcript sequence and contains 22 nucleotides of said xylan synthase sequence in sense orientation and 21 nucleotides of a corresponding antisense sequence that is complementary to the sense sequence. miRNA molecules are highly efficient at inhibiting the expression of endogenous genes, and the RNA interference they induce is inherited by subsequent generations of plants.

2. Polypeptide-Based Inhibition of Gene Expression

In one embodiment, the polynucleotide encodes a zinc finger protein that binds to a gene encoding an xylan synthase polypeptide, resulting in reduced expression of the gene. In particular embodiments, the zinc finger protein binds to a regulatory region of an xylan synthase gene. In other embodiments, the zinc finger protein binds to a messenger RNA encoding an xylan synthase polypeptide and prevents its translation. Methods of selecting sites for targeting by zinc finger proteins have been described, for example, in U.S. Pat. No. 6,453,242, and methods for using zinc finger proteins to inhibit the expression of genes in plants are described, for example, in U.S. Patent Publication No. 2003/0037355; each of which is herein incorporated by reference.

3. Polypeptide-Based Inhibition of Protein Activity

In some embodiments of the invention, the polynucleotide encodes an antibody that binds to at least one xylan synthase polypeptide, and reduces the enhanced activity of the xylan synthase polypeptide. In another embodiment, the binding of the antibody results in increased turnover of the antibody-xylan synthase complex by cellular quality control mechanisms. The expression of antibodies in plant cells and the inhibition of molecular pathways by expression and binding of antibodies to proteins in plant cells are well known in the art. See, for example, Conrad and Sonnewald, (2003) *Nature Biotech.* 21:35-36, incorporated herein by reference.

4. Gene Disruption

In some embodiments of the present invention, the activity of an xylan synthase polypeptide is reduced or eliminated by disrupting the gene encoding the xylan synthase polypeptide. The gene encoding the xylan synthase polypeptide may be disrupted by any method known in the art. For example, in one embodiment, the gene is disrupted by transposon tagging.

In another embodiment, the gene is disrupted by mutagenizing plants using random or targeted mutagenesis, and selecting for plants that have reduced activity.

i. Transposon Tagging

In one embodiment of the invention, transposon tagging is used to reduce or eliminate the activity of one or more xylan synthase polypeptides. Transposon tagging comprises inserting a transposon within an endogenous xylan synthase gene to reduce or eliminate expression of the xylan synthase polypeptide.

In this embodiment, the expression of one or more xylan synthase polypeptides is reduced or eliminated by inserting a transposon within a regulatory region or coding region of the gene encoding the xylan synthase polypeptide. A transposon that is within an exon, intron, 5' or 3' untranslated sequence, a promoter, or any other regulatory sequence of an xylan synthase gene may be used to reduce or eliminate the expression and/or activity of the encoded xylan synthase polypeptide.

Methods for the transposon tagging of specific genes in plants are well known in the art. See, for example, Maes, et al., (1999) *Trends Plant Sci.* 4:90-96; Dharmapuri and Sonti, (1999) *FEMS Microbiol. Lett.* 179:53-59; Meissner, et al., (2000) *Plant J.* 22:265-274; Phogat, et al., (2000) *J. Biosci.* 25:57-63; Walbot, (2000) *Curr. Opin. Plant Biol.* 2:103-107; Gai, et al., (2000) *Nucleic Acids Res.* 28:94-96; Fitzmaurice, et al., (1999) *Genetics* 153:1919-1928). In addition, the TUSC process for selecting Mu insertions in selected genes has been described in Bensen, et al., (1995) *Plant Cell* 7:75-84; Mena, et al., (1996) *Science* 274:1537-1540; and U.S. Pat. No. 5,962,764; each of which is herein incorporated by reference.

ii. Mutant Plants with Reduced Activity

Additional methods for decreasing or eliminating the expression of endogenous genes in plants are also known in the art and can be similarly applied to the instant invention. These methods include other forms of mutagenesis, such as ethyl methanesulfonate-induced mutagenesis, deletion mutagenesis, and fast neutron deletion mutagenesis used in a reverse genetics sense (with PCR) to identify plant lines in which the endogenous gene has been deleted. For examples of these methods see, Ohshima, et al., (1998) *Virology* 243:472-481; Okubara, et al., (1994) *Genetics* 137:867-874; and Quesada, et al., (2000) *Genetics* 154:421-436; each of which is herein incorporated by reference. In addition, a fast and automatable method for screening for chemically induced mutations, TILLING (Targeting Induced Local Lesions In Genomes), using denaturing HPLC or selective endonuclease digestion of selected PCR products is also applicable to the instant invention. See, McCallum, et al., (2000) *Nat. Biotechnol.* 18:455-457, herein incorporated by reference.

Mutations that impact gene expression or that interfere with the function (enhanced activity) of the encoded protein are well known in the art. Insertional mutations in gene exons usually result in null-mutants. Mutations in conserved residues are particularly effective in inhibiting the activity of the encoded protein. Conserved residues of plant xylan synthase polypeptides suitable for mutagenesis with the goal to eliminate xylan synthase activity have been described. Such mutants can be isolated according to well-known procedures, and mutations in different xylan synthase loci can be stacked by genetic crossing. See, for example, Gruis, et al., (2002) *Plant Cell* 14:2863-2882.

In another embodiment of this invention, dominant mutants can be used to trigger RNA silencing due to gene inversion and recombination of a duplicated gene locus. See, for example, Kusaba, et al., (2003) *Plant Cell* 15:1455-1467.

The invention encompasses additional methods for reducing or eliminating the activity of one or more xylan synthase polypeptide. Examples of other methods for altering or mutating a genomic nucleotide sequence in a plant are known in the art and include, but are not limited to, the use of RNA:DNA vectors, RNA:DNA mutational vectors, RNA:DNA repair vectors, mixed-duplex oligonucleotides, self-complementary RNA:DNA oligonucleotides, and recombinogenic oligonucleobases. Such vectors and methods of use are known in the art. See, for example, U.S. Pat. Nos. 5,565,350; 5,731,181; 5,756,325; 5,760,012; 5,795,972; and 5,871,984; each of which are herein incorporated by reference. See also, WO 98/49350, WO 99/07865, WO 99/25821, and Beetham, et al., (1999) *Proc. Natl. Acad. Sci. USA* 96:8774-8778; each of which is herein incorporated by reference.

Transfection/Transformation of Cells

The method of transformation/transfection is not critical to the instant invention; various methods of transformation or transfection are currently available. As newer methods are available to transform crops or other host cells they may be directly applied. Accordingly, a wide variety of methods have been developed to insert a DNA sequence into the genome of a host cell to obtain the transcription and/or translation of the sequence to effect phenotypic changes in the organism. Thus, any method which provides for effective transformation/transfection may be employed.

A. Plant Transformation

A DNA sequence coding for the desired polypeptide of the present invention, for example a cDNA or a genomic sequence encoding a full length protein, will be used to construct a recombinant expression cassette which can be introduced into the desired plant.

Isolated nucleic acid acids of the present invention can be introduced into plants according to techniques known in the art. Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway et al. (1986) Biotechniques 4:320-334), electroporation (Riggs et al. (1986) Proc. Natl. Acad. Sci. USA 83:5602-5606, *Agrobacterium*-mediated transformation (Townsend et al., U.S. Pat. No. 5,563,055), direct gene transfer (Paszkowski et al. (1984) EMBO J. 3:2717-2722), and ballistic particle acceleration (see, for example, Sanford et al., U.S. Pat. No. 4,945,050; Tomes et al. (1995) "Direct DNA Transfer into Intact Plant Cells via Microprojectile Bombardment," in Plant Cell, Tissue, and Organ Culture: Fundamental Methods, ed. Gamborg and Phillips (Springer-Verlag, Berlin); and McCabe et al. (1988) Biotechnology 6:923-926). Also see Weissinger et al. (1988) Ann. Rev. Genet. 22:421-477; Sanford et al. (1987) Particulate Science and Technology 5:27-37 (onion); Christou et al. (1988) Plant Physiol. 87:671-674 (soybean); McCabe et al. (1988) Bio/Technology 6:923-926 (soybean); Finer and McMullen (1991) In Vitro Cell Dev. Biol. 27 P: 175-182 (soybean); Singh et al. (1998) Theor. Appl. Genet. 96:319-324 (soybean); Datta et al. (1990) Biotechnology 8:736-740 (rice); Klein et al. (1988) Proc. Natl. Acad. Sci. USA 85:4305-4309 (maize); Klein et al. (1988) Biotechnology 6:559-563 (maize); Tomes, U.S. Pat. No. 5,240,855; Buising et al., U.S. Pat. Nos. 5,322,783 and 5,324,646; Tomes et al. (1995) "Direct DNA Transfer into Intact Plant Cells via Microprojectile Bombardment," in Plant Cell, Tissue, and Organ Culture: Fundamental Methods, ed. Gamborg (Springer-Verlag, Berlin) (maize); Klein et al. (1988) Plant Physiol. 91:440-444 (maize); Fromm et al. (1990) Biotechnology 8:833-839 (maize); Hooykaas-Van Slogteren et al. (1984) Nature (London) 311:763-764; Bowen et al., U.S. Pat. No. 5,736,369 (cereals); Bytebier et al. (1987) Proc. Natl. Acad. Sci. USA 84:5345-5349 (Liliaceae); De Wet et al. (1985) in The Experimental Manipulation of Ovule Tissues, ed. Chapman et al. (Longman, New York), pp. 197-209 (pollen); Kaeppler et al. (1990) Plant Cell Reports 9:415-418 and Kaeppler et al. (1992) Theor. Appl. Genet. 84:560-566 (whisker-mediated transformation); D'Halluin et al. (1992) Plant Cell 4:1495-1505 (electroporation); Li et al. (1993) Plant Cell Reports 12:250-255 and Christou and Ford (1995) Annals of Botany 75:407-413 (rice); Osjoda et al. (1996) Nature Biotechnology 14:745-750 and U.S. Pat. No. 5,981,840 (maize via *Agrobacterium tumefaciens*); all of which are herein incorporated by reference.

Another useful basic transformation protocol involves a combination of wounding by particle bombardment (Zhao et. al.), followed by use of *Agrobacterium* for DNA delivery, as described by Bidney et al., Plant Mol. Biol. 18:301-31 (1992). Useful plasmids for plant transformation include pBin 19. See Bevan, Nucleic Acids Research 12:8711-8721 (1984), and hereby incorporated by reference. This method is preferred for sunflower plants.

B. Transfection of Prokaryotes, Lower Eukaryotes, and Animal Cells

Animal and lower eukaryotic (e.g., yeast) host cells are competent or rendered competent for transfection by various means. There are several well-known methods of introducing DNA into animal cells. These include: calcium phosphate precipitation, fusion of the recipient cells with bacterial protoplasts containing the DNA, treatment of the recipient cells with liposomes containing the DNA, DEAE dextran, electroporation, biolistics, and micro-injection of the DNA directly into the cells. The transfected cells are cultured by means well known in the art. Kuchler, R. J., Biochemical Methods in Cell Culture and Virology, Dowden, Hutchinson and Ross, Inc. (1977).

Synthesis of Proteins

The proteins of the present invention can be constructed using non-cellular synthetic methods. Solid phase synthesis of proteins of less than about 50 amino acids in length may be accomplished by attaching the C-terminal amino acid of the sequence to an insoluble support followed by sequential addition of the remaining amino acids in the sequence. Techniques for solid phase synthesis are described by Barany and Merrifield, Solid-Phase Peptide Synthesis, pp. 3-284 in The Peptides: Analysis, Synthesis, Biology. Vol. 2: Special Methods in Peptide Synthesis, Part A.; Merrifield, et al., J. Am. Chem. Soc. 85: 2149-2156 (1963), and Stewart et al., Solid Phase Peptide Synthesis, 2nd ed., Pierce Chem. Co., Rockford, Ill. (1984). Proteins of greater length may be synthesized by condensation of the amino and carboxy termini of shorter fragments. Methods of forming peptide bonds by activation of a carboxy terminal end (e.g., by the use of the coupling reagent N,N'-dicycylohexylcarbodiimide) are known to those of skill.

Purification of Proteins

The proteins of the present invention may be purified by standard techniques well known to those of skill in the art. Recombinantly produced proteins of the present invention can be directly expressed or expressed as a fusion protein. The recombinant protein is purified by a combination of cell lysis (e.g., sonication, French press) and affinity chromatography. For fusion products, subsequent digestion of the fusion protein with an appropriate proteolytic enzyme releases the desired recombinant protein.

The proteins of this invention, recombinant or synthetic, may be purified to substantial purity by standard techniques well known in the art, including detergent solubilization, selective precipitation with such substances as ammonium sulfate, column chromatography, immunopurification methods, and others. See, for instance, R. Scopes, Protein Purification: Principles and Practice, Springer-Verlag: New York (1982); Deutscher, Guide to Protein Purification, Academic Press (1990). For example, antibodies may be raised to the proteins as described herein. Purification from *E. coli* can be achieved following procedures described in U.S. Pat. No. 4,511,503. The protein may then be isolated from cells expressing the protein and further purified by standard protein chemistry techniques as described herein. Detection of the expressed protein is achieved by methods known in the art and include, for example, radioimmunoassays, Western blotting techniques or immunoprecipitation.

Transgenic Plant Regeneration

Transformed plant cells which are derived by any of the above transformation techniques can be cultured to regenerate a whole plant which possesses the transformed genotype. Such regeneration techniques often rely on manipulation of certain phytohormones in a tissue culture growth medium. For transformation and regeneration of maize see, Gordon-Kamm et al., The Plant Cell, 2: 603-618 (1990).

Plants cells transformed with a plant expression vector can be regenerated, e.g., from single cells, callus tissue or leaf discs according to standard plant tissue culture techniques. It is well known in the art that various cells, tissues, and organs from almost any plant can be successfully cultured to regenerate an entire plant. Plant regeneration from cultured protoplasts is described in Evans et al., Protoplasts Isolation and Culture, Handbook of Plant Cell Culture, Macmillan Publishing Company, New York, pp. 124-176 (1983); and Binding, Regeneration of Plants, Plant Protoplasts, CRC Press, Boca Raton, pp. 21-73 (1985).

The regeneration of plants containing the foreign gene introduced by *Agrobacterium* from leaf explants can be achieved as described by Horsch et al., Science, 227: 1229-1231 (1985). In this procedure, transformants are grown in the presence of a selection agent and in a medium that induces the regeneration of shoots in the plant species being transformed as described by Fraley et al., Proc. Natl. Acad. Sci. (U.S.A), 80: 4803 (1983). This procedure typically produces shoots within two to four weeks and these transformant shoots are then transferred to an appropriate root-inducing medium containing the selective agent and an antibiotic to prevent bacterial growth. Transgenic plants of the present invention may be fertile or sterile.

Regeneration can also be obtained from plant callus, explants, organs, or parts thereof. Such regeneration techniques are described generally in Kleen et al., Ann. Rev. of Plant Phys. 38: 467-486 (1987). The regeneration of plants from either single plant protoplasts or various explants is well known in the art. See, for example, Methods for Plant Molecular Biology, A. Weissbach and H. Weissbach, eds., Academic Press, Inc., San Diego, Calif. (1988). This regeneration and growth process includes the steps of selection of transformant cells and shoots, rooting the transformant shoots and growth of the plantlets in soil. For maize cell culture and regeneration see generally, The Maize Handbook, Freeling and Walbot, Eds., Springer, New York (1994); Corn and Corn Improvement, 3rd edition, Sprague and Dudley Eds., American Society of Agronomy, Madison, Wis. (1988).

One of skill will recognize that after the recombinant expression cassette is stably incorporated in transgenic plants and confirmed to be operable, it can be introduced into other plants by sexual crossing. Any of a number of standard breeding techniques can be used, depending upon the species to be crossed. In vegetatively propagated crops, mature transgenic plants can be propagated by the taking of cuttings or by tissue culture techniques to produce multiple identical plants. Selection of desirable transgenics is made and new varieties are obtained and propagated vegetatively for commercial use. In seed propagated crops, mature transgenic plants can be self crossed to produce a homozygous inbred plant. The inbred plant produces seed containing the newly introduced heterologous nucleic acid. These seeds can be grown to produce plants that would produce the selected phenotype.

Parts obtained from the regenerated plant, such as flowers, seeds, leaves, branches, fruit, and the like are included in the invention, provided that these parts comprise cells comprising the isolated nucleic acid of the present invention. Progeny and variants, and mutants of the regenerated plants are also included within the scope of the invention, provided that these parts comprise the introduced nucleic acid sequences. Transgenic plants expressing the selectable marker can be screened for transmission of the nucleic acid of the present invention by, for example, standard immunoblot and DNA detection techniques.

Transgenic lines are also typically evaluated on levels of expression of the heterologous nucleic acid. Expression at the RNA level can be determined initially to identify and quantitate expression-positive plants. Standard techniques for RNA analysis can be employed and include PCR amplification assays using oligonucleotide primers designed to amplify only the heterologous RNA templates and solution hybridization assays using heterologous nucleic acid-specific probes.

The RNA-positive plants can then analyzed for protein expression by Western immunoblot analysis using the specifically reactive antibodies of the present invention. In addition, in situ hybridization and immunocytochemistry according to standard protocols can be done using heterologous nucleic acid specific polynucleotide probes and antibodies, respectively, to localize sites of expression within transgenic tissue. Generally, a number of transgenic lines are usually screened for the incorporated nucleic acid to identify and select plants with the most appropriate expression profiles.

A preferred embodiment is a transgenic plant that is homozygous for the added heterologous nucleic acid; i.e., a transgenic plant that contains two added nucleic acid sequences, one gene at the same locus on each chromosome of a chromosome pair. A homozygous transgenic plant can be obtained by sexually mating (selfing) a heterozygous transgenic plant that contains a single added heterologous nucleic acid, germinating some of the seed produced and analyzing the resulting plants produced for altered expression of a polynucleotide of the present invention relative to a control plant (i.e., native, nontransgenic). Back-crossing to a parental plant and out-crossing with a non-transgenic plant are also contemplated.

Modulation of Polypeptide Levels and/or Composition

The present invention further provides a method for modulating (i.e., increasing or decreasing) the concentration or ratio of the polypeptides of the present invention in a plant or part thereof. Modulation can be effected by increasing or decreasing the concentration and/or the ratio of the polypeptides of the present invention in a plant.

The method comprises introducing into a plant cell a recombinant expression cassette comprising a polynucleotide of the present invention as described above to obtain a transformed plant cell, culturing the transformed plant cell under plant cell growing conditions, and inducing or repressing expression of a polynucleotide of the present invention in the plant for a time sufficient to modulate concentration and/or the ratios of the polypeptides in the plant or plant part.

In some embodiments, the concentration and/or ratios of polypeptides of the present invention in a plant may be modulated by altering, in vivo or in vitro, the promoter of a gene to up- or down-regulate gene expression. In some embodiments, the coding regions of native genes of the present invention can be altered via substitution, addition, insertion, or deletion to decrease activity of the encoded enzyme. See, e.g., Kmiec, U.S. Pat. No. 5,565,350; Zarling et al., PCT/US93/03868. And in some embodiments, an isolated nucleic acid (e.g., a vector) comprising a promoter sequence is transfected into a plant cell.

Subsequently, a plant cell comprising the promoter operably linked to a polynucleotide of the present invention is selected for by means known to those of skill in the art such as, but not limited to, Southern blot, DNA sequencing, or PCR analysis using primers specific to the promoter and to the gene and detecting amplicons produced therefrom. plant or plant part altered or modified by the foregoing embodiments is grown under plant forming conditions for a time sufficient to modulate the concentration and/or ratios of polypeptides of the present invention in the plant. Plant forming conditions are well known in the art and discussed briefly, supra.

In general, concentration or the ratios of the polypeptides is increased or decreased by at least 5%, 10%, 20%, 30%, 40%, 50%, 60%, 70%, 80%, or 90% relative to a native control plant, plant part, or cell lacking the aforementioned recombinant expression cassette. Modulation in the present invention may occur during and/or subsequent to growth of the plant to the desired stage of development. Modulating nucleic acid expression temporally and/or in particular tissues can be controlled by employing the appropriate promoter operably linked to a polynucleotide of the present invention in, for example, sense or antisense orientation as discussed in greater detail, supra. Induction of expression of a polynucleotide of the present invention can also be controlled by exogenous administration of an effective amount of inducing compound. Inducible promoters and inducing compounds which activate expression from these promoters are well known in the art. In preferred embodiments, the polypeptides of the present invention are modulated in monocots, particularly maize.

Molecular Markers

The present invention provides a method of genotyping a plant comprising a polynucleotide of the present invention. Optionally, the plant is a monocot, such as maize or sorghum. Genotyping provides a means of distinguishing homologs of a chromosome pair and can be used to differentiate segregants in a plant population. Molecular marker methods can be used for phylogenetic studies, characterizing genetic relationships among crop varieties, identifying crosses or somatic hybrids, localizing chromosomal segments affecting monogenic traits, map based cloning, and the study of quantitative inheritance. See, e.g., Clark, Ed., Plant Molecular Biology: A Laboratory Manual. Berlin, Springer Verlag, 1997. Chapter 7. For molecular marker methods, see generally, "The DNA Revolution" in: Paterson, A. H., Genome Mapping in Plants (Austin, Tex., Academic Press/R. G. Landis Company, 1996) pp. 7-21.

Genetic marker profiles can be obtained by techniques such as Restriction Fragment Length Polymorphisms (RFLPs), Randomly Amplified Polymorphic DNAs (RAPDs), Arbitrarily Primed Polymerase Chain Reaction (AP-PCR), DNA Amplification Fingerprinting (DAF), Sequence Characterized Amplified Regions (SCARs), Amplified Fragment Length Polymorphisms (AFLPs), Simple Sequence Repeats (SSRs) which are also referred to as Microsatellites, and Single Nucleotide Polymorphisms (SNPs). For example, see Berry, Don et al., "Assessing Probability of Ancestry Using Simple Sequence Repeat Profiles: Applications to Maize Hybrids and Inbreds", Genetics, 2002, 161:813-824, and Berry, Don et al., "Assessing Probability of Ancestry Using Simple Sequence Repeat Profiles: Applications to Maize Inbred Lines and Soybean Varieties", Genetics, 2003, 165: 331-342.

A genetic map can be generated, primarily via conventional Restriction Fragment Length Polymorphisms (RFLP), Polymerase Chain Reaction (PCR) analysis, Simple Sequence Repeats (SSR) and Single Nucleotide Polymorphisms (SNP) that identifies the approximate chromosomal location of the integrated DNA molecule. For exemplary methodologies in this regard, see Glick and Thompson, Methods in Plant Molecular Biology and Biotechnology 269-284 (CRC Press, Boca Raton, 1993). Wang et al. discuss "Large Scale Identification, Mapping and Genotyping of Single-Nucleotide Polymorphisms in the Human Genome", Science, 280:1077-1082, 1998, and similar capabilities are available for plant genomes. Map comparisons would involve hybridizations, RFLP, PCR, SSR and sequencing, all of which are conventional techniques. SNPs may also be used alone or in combination with other techniques.

UTRs and Codon Preference

In general, translational efficiency has been found to be regulated by specific sequence elements in the 5' non-coding or untranslated region (5'UTR) of the RNA. Positive sequence motifs include translational initiation consensus sequences (Kozak, Nucleic Acids Res. 15: 8125 (1987)) and the 7-methylguanosine cap structure (Drummond et al., Nucleic Acids Res. 13:7375 (1985)). Negative elements include stable intramolecular 5'UTR stem-loop structures (Muesing et al., Cell 48: 691 (1987)) and AUG sequences or short open reading frames preceded by an appropriate AUG in the 5'UTR (Kozak, supra, Rao et al., Mol. and Cell. Biol. 8:284 (1988)). Accordingly, the present invention provides 5' and/or 3' untranslated regions for modulation of translation of heterologous coding sequences.

Further, the polypeptide-encoding segments of the polynucleotides of the present invention can be modified to alter codon usage. Altered codon usage can be employed to alter translational efficiency and/or to optimize the coding sequence for expression in a desired host such as to optimize the codon usage in a heterologous sequence for expression in maize. Codon usage in the coding regions of the polynucleotides of the present invention can be analyzed statistically using commercially available software packages such as "Codon Preference" available from the University of Wisconsin Genetics Computer Group (see Devereaux et al., Nucleic Acids Res. 12: 387-395 (1984)) or MacVector 4.1 (Eastman Kodak Co., New Haven, Conn.). Thus, the present invention provides a codon usage frequency characteristic of the coding region of at least one of the polynucleotides of the present invention. The number of polynucleotides that can be used to determine a codon usage frequency can be any integer from 1 to the number of polynucleotides of the present invention as provided herein. Optionally, the polynucleotides will be full-length sequences. An exemplary number of sequences for statistical analysis can be at least 1, 5, 10, 20, 50, or 100.

Sequence Shuffling

The present invention provides methods for sequence shuffling using polynucleotides of the present invention, and compositions resulting therefrom. Sequence shuffling is described in PCT publication No. WO 97/20078. See also, Zhang, J.-H., et al. Proc. Natl. Acad. Sci. USA 94: 4504-4509 (1997). Generally, sequence shuffling provides a means for generating libraries of polynucleotides having a desired characteristic which can be selected or screened for. Libraries of recombinant polynucleotides are generated from a population of related sequence polynucleotides which comprise sequence regions which have substantial sequence identity and can be homologously recombined in vitro or in vivo. The population of sequence-recombined polynucleotides comprises a subpopulation of polynucleotides which possess desired or advantageous characteristics and which can be selected by a suitable selection or screening method. The characteristics can be any property or attribute capable of being selected for or detected in a screening system, and may include properties of: an encoded protein, a transcriptional element, a sequence controlling transcription, RNA processing, RNA stability, chromatin conformation, translation, or other expression property of a gene or transgene, a replicative element, a protein-binding element, or the like, such as any feature which confers a selectable or detectable property. In some embodiments, the selected characteristic will be a decreased Km and/or increased KCat over the wild-type protein as provided herein. In other embodiments, a protein or polynucleotide generated from sequence shuffling will have a ligand binding affinity greater than the non-shuffled wild-type polynucleotide. The increase in such properties can be at least 110%, 120%, 130%, 140% or at least 150% of the wild-type value.

Generic and Consensus Sequences

Polynucleotides and polypeptides of the present invention further include those having: (a) a generic sequence of at least two homologous polynucleotides or polypeptides, respectively, of the present invention; and, (b) a consensus sequence of at least three homologous polynucleotides or polypeptides, respectively, of the present invention. The generic sequence of the present invention comprises each species of polypeptide or polynucleotide embraced by the generic polypeptide or polynucleotide sequence, respectively. The individual species encompassed by a polynucleotide having an amino acid or nucleic acid consensus sequence can be used to generate antibodies or produce nucleic acid probes or primers to screen for homologs in other species, genera, families, orders, classes, phyla, or kingdoms. For example, a polynucleotide having a consensus sequence from a gene family of Zea mays can be used to generate antibody or nucleic acid probes or primers to other Gramineae species such as wheat, rice, or sorghum.

Alternatively, a polynucleotide having a consensus sequence generated from orthologous genes can be used to identify or isolate orthologs of other taxa. Typically, a polynucleotide having a consensus sequence will be at least 25, 30, or 40 amino acids in length, or 20, 30, 40, 50, 100, or 150 nucleotides in length. As those of skill in the art are aware, a conservative amino acid substitution can be used for amino acids which differ amongst aligned sequence but are from the same conservative substitution group as discussed above. Optionally, no more than 1 or 2 conservative amino acids are substituted for each 10 amino acid length of consensus sequence.

Similar sequences used for generation of a consensus or generic sequence include any number and combination of allelic variants of the same gene, orthologous, or paralogous sequences as provided herein. Optionally, similar sequences used in generating a consensus or generic sequence are identified using the BLAST algorithm's smallest sum probability (P (N)). Various suppliers of sequence-analysis software are listed in chapter 7 of Current Protocols in Molecular Biology, F. M. Ausubel et al., Eds., Current Protocols, a joint venture between Greene Publishing Associates, Inc. and John Wiley & Sons, Inc. (Supplement 30).

A polynucleotide sequence is considered similar to a reference sequence if the smallest sum probability in a comparison of the test nucleic acid to the reference nucleic acid is less than about 0.1, more preferably less than about 0.01, or 0.001, and most preferably less than about 0.0001, or 0.00001. Similar polynucleotides can be aligned and a consensus or generic sequence generated using multiple sequence alignment software available from a number of commercial suppliers such as the Genetics Computer Group's (Madison, Wis.) PILEUP software, Vector NTI's (North Bethesda, Md.) ALIGNX, or Genecode's (Ann Arbor, Mich.) SEQUENCHER. Conveniently, default parameters of such software can be used to generate consensus or generic sequences.

The present invention further provides methods for detecting a polynucleotide of the present invention in a nucleic acid sample suspected of containing a polynucleotide of the present invention, such as a plant cell lysate, particularly a lysate of maize. In some embodiments, a gene of the present invention or portion thereof can be amplified prior to the step of contacting the nucleic acid sample with a polynucleotide of the present invention. The nucleic acid sample is contacted with the polynucleotide to form a hybridization complex. The polynucleotide hybridizes under stringent conditions to a gene encoding a polypeptide of the present invention. Formation of the hybridization complex is used to detect a gene encoding a polypeptide of the present invention in the nucleic acid sample. Those of skill will appreciate that an isolated nucleic acid comprising a polynucleotide of the present invention should lack cross-hybridizing sequences in common with non-target genes that would yield a false positive result.

Detection of the hybridization complex can be achieved using any number of well known methods. For example, the nucleic acid sample, or a portion thereof, may be assayed by hybridization formats including but not limited to, solution phase, solid phase, mixed phase, or in situ hybridization assays. Briefly, in solution (or liquid) phase hybridizations, both the target nucleic acid and the probe or primer are free to interact in the reaction mixture. In solid phase hybridization assays, probes or primers are typically linked to a solid support where they are available for hybridization with target nucleic acid in solution. In mixed phase, nucleic acid intermediates in solution hybridize to target nucleic acids in solution as well as to a nucleic acid linked to a solid support. In in situ hybridization, the target nucleic acid is liberated from its cellular surroundings in such as to be available for hybridization within the cell while preserving the cellular morphology for subsequent interpretation and analysis. The following articles provide an overview of the various hybridization assay formats: Singer et al., Biotechniques 4 (3): 230-250 (1986); Haase et al., Methods in Virology, Vol. VII, pp. 189-226 (1984); Wilkinson, The theory and practice of in situ hybridization in: In situ Hybridization, D. G. Wilkinson, Ed., IRL Press, Oxford University Press, Oxford; and NucleicAcid Hybridization: A Practical Approach, Hames, B. D. and Higgins, S. J., Eds., IRL Press (1987).

Nucleic Acid Labels and Detection Methods

The means by which nucleic acids of the present invention are labeled is not a critical aspect of the present invention and can be accomplished by any number of methods currently known or later developed. Detectable labels suitable for use in the present invention include any composition detectable by spectroscopic, radioisotopic, photochemical, biochemical, immunochemical, electrical, optical or chemical means.

Useful labels in the present invention include biotin for staining with labeled streptavidin conjugate, magnetic beads, fluorescent dyes (e.g., fluorescein, Texas red, rhodamine, green fluorescent protein, and the like), radiolabels (e.g., 3H, 125I, 35S, 14C, or 32p), enzymes (e.g., horse radish peroxidase, alkaline phosphatase and others commonly used in an ELISA), and colorimetric labels such as colloidal gold or colored glass or plastic (e.g., polystyrene, polypropylene, latex, etc.) beads.

Nucleic acids of the present invention can be labeled by any one of several methods typically used to detect the presence of hybridized nucleic acids. One common method of detection is the use of autoradiography using probes labeled with 3H, 125I, 35S, 14C, or 32p, or the like. The choice of radioactive isotope depends on research preferences due to ease of synthesis, stability, and half lives of the selected isotopes. Other labels include ligands which bind to antibodies labeled with fluorophores, chemiluminescent agents, and enzymes. Alternatively, probes can be conjugated directly with labels such as fluorophores, chemiluminescent agents or enzymes. The choice of label depends on sensitivity required, ease of conjugation with the probe, stability requirements, and available instrumentation. Labeling the nucleic acids of the present invention is readily achieved such as by the use of labeled PCR primers.

In some embodiments, the label is simultaneously incorporated during the amplification step in the preparation of the nucleic acids. Thus, for example, polymerase chain reaction (PCR) with labeled primers or labeled nucleotides will provide a labeled amplification product. In another embodiment, transcription amplification using a labeled nucleotide (e.g., fluorescein-labeled UTP and/or CTP) incorporates a label into the transcribed nucleic acids.

Non-radioactive probes are often labeled by indirect means. For example, a ligand molecule is covalently bound to the probe. The ligand then binds to an anti-ligand molecule which is either inherently detectable or covalently bound to a detectable signal system, such as an enzyme, a fluorophore, or a chemiluminescent compound. Enzymes of interest as labels will primarily be hydrolases, such as phosphatases, esterases and glycosidases, or oxidoreductases, particularly peroxidases. Fluorescent compounds include fluorescein and its derivatives, rhodamine and its derivatives, dansyl, umbelliferone, etc. Chemiluminescers include luciferin, and 2,3-dihydrophthalazinediones, e.g., luminol.

Ligands and anti-ligands may be varied widely. Where a ligand has a natural anti-ligand, namely ligands such as biotin, thyroxine, and cortisol, it can be used in conjunction with its labeled, naturally occurring anti-ligands. Alternatively, any haptenic or antigenic compound can be used in combination with an antibody.

Probes can also be labeled by direct conjugation with a label. For example, cloned DNA probes have been coupled directly to horseradish peroxidase or alkaline phosphatase.

Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of the enzyme on the substrate, and colorimetric labels are detected by simply visualizing the colored label.

Antibodies to Proteins

Antibodies can be raised to a protein of the present invention, including individual, allelic, strain, or species variants, and fragments thereof, both in their naturally occurring (full-length) forms and in recombinant forms. Additionally, antibodies are raised to these proteins in either their native configurations or in non-native configurations. Many methods of making antibodies are known to persons of skill. A variety of analytic methods are available to generate a hydrophilicity profile of a protein of the present invention. Such methods can be used to guide the artisan in the selection of peptides of the present invention for use in the generation or selection of antibodies which are specifically reactive, under immunogenic conditions, to a protein of the present invention. See, e.g., J. Janin, Nature, 277 (1979) 491-492; Wolfenden, et al., Biochemistry 20 (1981) 849-855; Kyte and Doolite, J. Mol. Biol. 157 (1982) 105-132; Rose, et al., Science 229 (1985) 834838. The following discussion is presented as a general overview of the techniques available; however, one of skill will recognize that many variations upon the following methods are known.

A number of immunogens are used to produce antibodies specifically reactive with a protein of the present invention. An isolated recombinant, synthetic, or native polynucleotide of the present invention are the preferred antigens for the production of monoclonal or polyclonal antibodies. Polypeptides of the present invention are optionally denatured, and optionally reduced, prior to formation of antibodies for screening expression libraries or other assays in which a putative protein of the present invention is expressed or denatured in a non-native secondary, tertiary, or quarternary structure.

The protein of the present invention is then injected into an animal capable of producing antibodies. Either monoclonal or polyclonal antibodies can be generated for subsequent use in immunoassays to measure the presence and quantity of the protein of the present invention. Methods of producing polyclonal antibodies are known to those of skill in the art. In brief, an antigen, preferably a purified protein, a protein coupled to an appropriate carrier (e.g., GST, keyhole limpet hemanocyanin, etc.), or a protein incorporated into an immunization vector such as a recombinant vaccinia virus (see, U.S. Pat. No. 4,722,848) is mixed with an adjuvant and animals are immunized with the mixture. The animal's immune response to the immunogen preparation is monitored by taking test bleeds and determining the titer of reactivity to the protein of interest. When appropriately high titers of antibody to the immunogen are obtained, blood is collected from the animal and antisera are prepared. Further fractionation of the antisera to enrich for antibodies reactive to the protein is performed where desired (See, e.g., Coligan, Current Protocols in Immunology, Wiley/Greene, NY (1991); and Harlow and Lane, Antibodies: A Laboratory Manual, Cold Spring Harbor Press, NY (1989)).

Antibodies, including binding fragments and single chain recombinant versions thereof, against predetermined fragments of a protein of the present invention are raised by immunizing animals, e.g., with conjugates of the fragments with carrier proteins as described above. Typically, the immunogen of interest is a protein of at least about 5 amino acids, more typically the protein is 10 amino acids in length, preferably, 15 amino acids in length and more preferably the protein is 20 amino acids in length or greater. The peptides are typically coupled to a carrier protein (e.g., as a fusion protein), or are recombinantly expressed in an immunization vector. Antigenic determinants on peptides to which antibodies bind are typically 3 to 10 amino acids in length.

Monoclonal antibodies are prepared from hybrid cells secreting the desired antibody. Monoclonals antibodies are screened for binding to a protein from which the antigen was derived. Specific monoclonal and polyclonal antibodies will usually have an antibody binding site with an affinity constant for its cognate monovalent antigen at least between 106-107, usually at least 108, preferably at least 109, more preferably at least 101, and most preferably at least 101 liters/mole.

In some instances, it is desirable to prepare monoclonal antibodies from various mammalian hosts, such as mice, rodents, primates, humans, etc. Description of techniques for preparing such monoclonal antibodies are found in, e.g., Basic and Clinical Immunology, 4th ed., Stites et al., Eds., Lange Medical Publications, Los Altos, Calif., and references cited therein; Harlow and Lane, Supra; Goding, Monoclonal Antibodies: Principles and Practice, 2nd ed., Academic Press, New York, N.Y. (1986); and Kohler and Milstein, Nature 256: 495-497 (1975). Summarized briefly, this method proceeds by injecting an animal with an antigen comprising a protein of the present invention. The animal is then sacrificed and cells taken from its spleen, which are fused with myeloma cells. The result is a hybrid cell or "hybridoma" that is capable of reproducing in vitro.

The population of hybridomas is then screened to isolate individual clones, each of which secrete a single antibody species to the antigen. In this manner, the individual antibody species obtained are the products of immortalized and cloned single B cells from the immune animal generated in response to a specific site recognized on the antigenic substance.

Other suitable techniques involve selection of libraries of recombinant antibodies in phage or similar vectors (see, e.g., Huse et al., Science 246: 1275-1281 (1989); and Ward, et al., Nature 341: 544-546 (1989); and Vaughan et al., Nature Biotechnology, 14: 309-31.4 (1996)). Alternatively, high avidity human monoclonal antibodies can be obtained from transgenic mice comprising fragments of the unrearranged human heavy and light chain Ig loci (i.e., mini locus transgenic mice). Fishwild et al., Nature Biotech., 14:845-851 (1996). Also, recombinant immunoglobulins may be produced. See, Cabilly, U.S. Pat. No. 4,816,567; and Queen et al., Proc. Net'l Acad. Sci. 86:10029-10033 (1989). The antibodies of this invention are also used for affinity chromatography in isolating proteins of the present invention. Columns are prepared, e.g., with the antibodies linked to a solid support, e.g., particles, such as agarose, SEPHADEX, or the like, where a cell lysate is passed through the column, washed, and treated with increasing concentrations of a mild denaturant, whereby purified protein are released.

The antibodies can be used to screen expression libraries for particular expression products such as normal or abnormal protein. Usually the antibodies in such a procedure are labeled with a moiety allowing easy detection of presence of antigen by antibody binding. Antibodies raised against a protein of the present invention can also be used to raise anti-idiotypic antibodies. These are useful for detecting or diagnosing various pathological conditions related to the presence of the respective antigens.

Frequently, the proteins and antibodies of the present invention will be labeled by joining, either covalently or non-covalently, a substance which provides for a detectable signal. A wide variety of labels and conjugation techniques are known and are reported extensively in both the scientific and patent literature. Suitable labels include radionucleotides, enzymes, substrates, cofactors, inhibitors, fluorescent moieties, chemiluminescent moieties, magnetic particles, and the like.

Gene Stacking

In certain embodiments the xylan synthase nucleic acid sequences of the present invention can be stacked with any combination of polynucleotide sequences of interest in order to create plants with a desired phenotype. For example, the xylan synthase polynucleotides may be stacked with any other polynucleotides of the present invention, such as any combination of xylan synthases (SEQ ID NOS: 1) or other CslA polypeptides, with other genes implicated in polysaccharide synthase enzymatic activities including, but not limited to, xyloglucan alpha 1-2 fucosyltransferase; galactinol synthase; KOJAK; sucrose:sucrose 1-fructosyltransferase; fructan:fructan 1-fructosyltransferase; and Suc:fructan-6-fructosyltransferase. (See Wulff et al. (2000) *Plant Physiol.* 122:867-877; Sprenger et al. (2000) *Plant J.* 21:249-258; Favery et al. (2001) *Genes Dev.* 15:79-89; Reid (2000) *Curr. Opin. Plant Biol.* 3:512-516; Hellwege et al. (2000) *Proc. Natl. Acad. Sci.* 15:8699-8704; Muller et al. (2000) *Plant Physiol.* 123:265-274; Geshi et al. (2000) *Planta* 210:622-629, and U.S. Pat. No. 6,194,638, each of which is herein incorporated by reference. The combinations generated can also include multiple copies of any one of the polynucleotides of interest. The xylan synthase polynucleotides can also be stacked with any other gene or combination of genes to produce plants with a variety of desired trait combinations including but not limited to traits desirable for animal feed such as high oil genes (e.g., U.S. Pat. No. 6,232,529); balanced amino acids (e.g. hordothionins (U.S. Pat. Nos. 5,990, 389; 5,885,801; 5,885,802; and 5,703,409); barley high lysine (Williamson et al. (1987) *Eur. J. Biochem.* 165:99-106; and WO 98/20122); and high methionine proteins (Pedersen et al. (1986) *J. Biol. Chem.* 261:6279; Kirihara et al. (1988) *Gene* 71:359; and Musumura et al. (1989) *Plant Mol. Biol.* 12: 123)); increased digestibility (e.g., modified storage proteins (U.S. application Ser. No. 10/053,410, filed Nov. 7, 2001); and thioredoxins (U.S. application Ser. No. 10/005, 429, filed Dec. 3, 2001)), the disclosures of which are herein incorporated by reference. The xylan synthase polynucleotides can also be stacked with traits desirable for insect, disease or herbicide resistance (e.g., *Bacillus thuringiensis* toxic proteins (U.S. Pat. Nos. 5,366,892; 5,747,450; 5,737, 514; 5,723,756; 5,593,881; Geiser et al (1986) *Gene* 48:109); lectins (Van Damme et al. (1994) *Plant Mol. Biol.* 24:825); fumonisin detoxification genes (U.S. Pat. No. 5,792,931); avirulence and disease resistance genes (Jones et al. (1994) *Science* 266:789; Martin et al. (1993) *Science* 262:1432; Mindrinos et al. (1994) *Cell* 78:1089); acetolactate synthase (ALS) mutants that lead to herbicide resistance such as the S4 and/or Hra mutations; inhibitors of glutamine synthase such as phosphinothricin or basta (e.g., bar gene); and glyphosate resistance (EPSPS gene)); and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE) and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) *J. Bacteriol.* 170:5837-5847) facilitate expression of polyhydroxyalkanoates (PHAs)), the disclosures of which are herein incorporated by reference. One could also combine the xylan synthase polynucleotides with polynucleotides providing agronomic traits such as male sterility (e.g., see U.S. Pat. No. 5,583,210), stalk strength, flowering time, or transformation technology traits such as cell cycle regulation or gene targeting (e.g. WO 99/61619; WO 00/17364; WO 99/25821), the disclosures of which are herein incorporated by reference.

These stacked combinations can be created by any method including but not limited to cross breeding plants by any conventional or TopCross methodology, or genetic transformation. If the traits are stacked by genetically transforming the plants, the polynucleotide sequences of interest can be combined at any time and in any order. For example, a transgenic plant comprising one or more desired traits can be used as the target to introduce further traits by subsequent transformation. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combine with any combination of other suppression cassettes or overexpression cassettes to generate the desired combination of traits in the plant.

Furthermore, it is recognized that the methods of the invention may employ a nucleotide construct that is capable of directing, in a transformed plant, the expression of at least one protein, or at least one RNA, such as, for example, an antisense RNA that is complementary to at least a portion of an mRNA of interest. Typically such a nucleotide construct is comprised of a coding sequence for a protein or an RNA operably linked to 5' and 3' transcriptional regulatory regions. Alternatively, it is also recognized that the methods of the invention may employ a nucleotide construct that is not capable of directing, in a transformed plant, the expression of a protein or an RNA.

In addition, it is recognized that methods of the present invention do not depend on the incorporation of the entire nucleotide construct into the genome, only that the plant or cell thereof is altered as a result of the introduction of the nucleotide construct into a cell. In one embodiment of the invention, the genome may be altered following the introduction of the nucleotide construct into a cell. For example, the nucleotide construct, or any part thereof, may incorporate into the genome of the plant. Alterations to the genome of a plant of the present invention include, but are not limited to, additions, deletions, and substitutions of nucleotides in the genome. While the methods of the present invention do not depend on additions, deletions, or substitutions of any particular number of nucleotides, it is recognized that such additions, deletions, or substitutions comprise at least one nucleotide.

Although the present invention has been described in some detail by way of illustration and example for purposes of clarity of understanding, it will be obvious that certain changes and modifications may be practiced within the scope of the appended claims.

EXAMPLES

Example 1

Plant Xylan Synthase and their Uses

Availability of the complete genome sequences of *Arabidopsis* and rice, made it possible to isolate all the members of the cellulose synthase super gene family (Richmond and Somerville 2000; Hazen et al. 2002), which was accomplished through searching for homologous genes to a cellulose synthase gene that had previously been isolated from cotton (Pear et al. 1996). Proof for the involvement of any of these genes in β-glycan formation was obtained when a cellulose synthase-like (Csl) gene from guar that made β-mannan was functionally expressed in a heterologous system (Dhugga et al. 2004; Liepman et al. 2005). An alternative approach was used by Burton et al. (2006) to identify mixed-linked glucan (MLG) synthase genes whereby they expressed the CslF sequences in *Arabidopsis* (Burton et al. 2006). MLG does not occur naturally in *Arabidopsis* walls. Detection of MLG was by immunocytochemistry using antibodies specific to MLG in the walls of CslF-expressing *Arabidopsis* cells indicated the involvement of these sequences in MLG formation (Burton et al. 2006). Genes that encode xylan synthase, the enzyme that catalyzes the formation of the backbone of arabinoxylan, remain unknown thus far. We report the identification of this class of genes, which we accomplished using the tools of genomics, phylogenetics analysis, and molecular biology.

Complete sets of Csl genes in the two plants have been identified. *Arabidopsis* is predicted to have 30 Csl genes, and rice ~37 (Richmond and Somerville 2000; Hazen et al. 2002). Csl genes show striking similarities as well as differences between rice and *Arabidopsis*, which may reflect the similarities and differences in the hemicellulose composition of dicots and graminaceous monocots (Carpita 1996). Some members of the Csl family are common to both rice (monocot) and *Arabidopsis* (dicot), i.e., CslA, CslC, CslD, and CslE. Others are specific either to rice (CslF and CslH) or to *Arabidopsis* (CslB and CslG). Genes in the Csl superfamily are currently the most promising candidates for encoding the glycosyl synthases that make the hemicellulose backbones of plant cell walls. This dimorphism is expected to be reflected in distinct patterns of wall biosynthetic enzymes and hence encoding genes. Consistent with both the similarities and differences between the walls of dicots and cereals, the Csl gene superfamily shows both degrees of conservation and differences between *Arabidopsis* and rice.

Identification of the Csl Sequences from Psyllium Developing Seed Coats:

Psyllium seed coats are ideal for studying hemicellulose biosynthesis because they are rich in one polysaccharide, arabinoxylan (Naghdi Badi et al. 2004). Psyllium is the common name used for several members of the plant genus *Plantago* whose seeds are used commercially for the production of mucilage (Naghdi Badi et al. 2004). Recent interest in psyllium has arisen mainly because of its use in high fiber breakfast cereals. Psyllium mucilage absorbs excess water, providing lubrication to the alimentary canal and stimulating normal bowel elimination. Its desirable effects have been reported in cases of Type II diabetes, hypercholestrolemia, and as a well known laxative (Hasler et al. 2000; Young 2002; Edwards et al. 2003; Naghdi Badi et al. 2004; Ohr 2004; Ziai et al. 2005). Although the branching pattern may be different between the arabinoxylan of psyllium seed coat and that of other plants, the backbone is identical (Edwards et al. 2003). Identification of a xylan synthase from psyllium will facilitate the identification of similar sequences from maize. A similar approach was used for the identification of mannan synthase from guar; endosperm in guar seeds consists nearly exclusively of galactomannan and as a result the most highly expressed Csl turned out be the mannan synthase (Dhugga et al. 2004).

Psyllium seed coat (~40% of seed dry weight) is composed of 95% fiber as storage material. Seventy five percent of the seed coat consists of the water-soluble arabinoxylan fraction. We believe the transcript levels of xylan synthases and arabinosyltransferases should be relatively abundant during the log phase of seed coat development. Therefore, developing seed coats of psyllium are an ideal tissue to identify xylan synthase genes.

Figure 2:
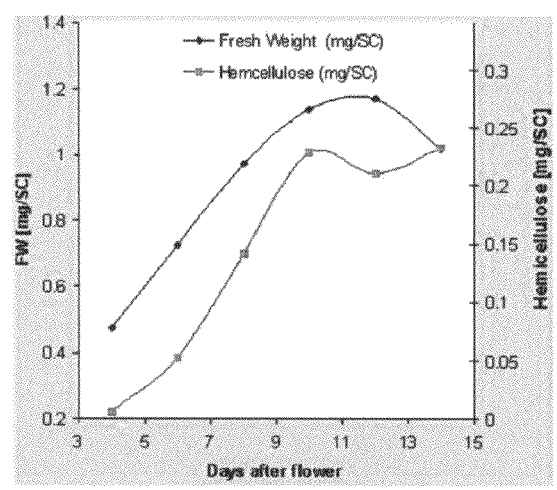
Figure 3:
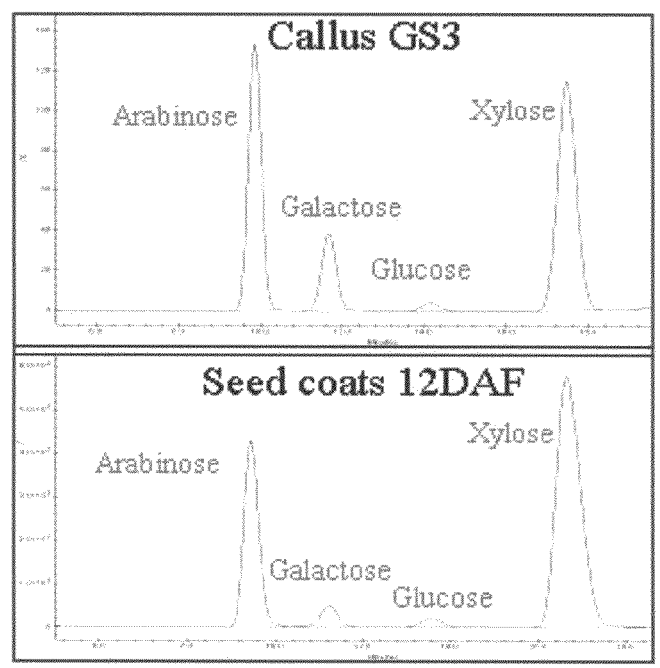

Psyllium developing fruit and the cross-section are shown in the FIG. 1. Developing seed coats from 4 to 14 days after flowering were collected. Fresh weight and hemicellulose level per seed coat are plotted against days after flowering. As shown in FIG. 2, hemicellulose accumulation exhibited a linear increase from 6 to 10 DAF. Hence, developing seed coats from 8 to 10 DAF were used to prepare mRNA for library construction. Cell wall analysis was also performed. The sugar compositions are quite similar to that from corn callus as shown in FIG. 3.

Identification of a CslA gene as a xylan synthase: A cDNA library was constructed from the seed coat dissected from the 8-10 DAF psyllium seeds and subjected to EST sequencing. A total of 10247 EST sequences, on the average 500 bp in length, were obtained. These sequences assembled into 939 contigs, leaving 4055 singletons for a total of 4994 unique sequences. Out of this set of unique sequences, only two Csl sequences were identified. One of these was represented by 7 independent ESTs in a single contig whereas the second was represented by only one EST. The frequency of occurrence of the sequences for the more abundantly expressed Csl sequence is comparable to that of guar seed mannan synthase (Dhugga et al. 2004). This strongly suggests that this sequence represents a xylan synthase in psyllium.

Figure 4:
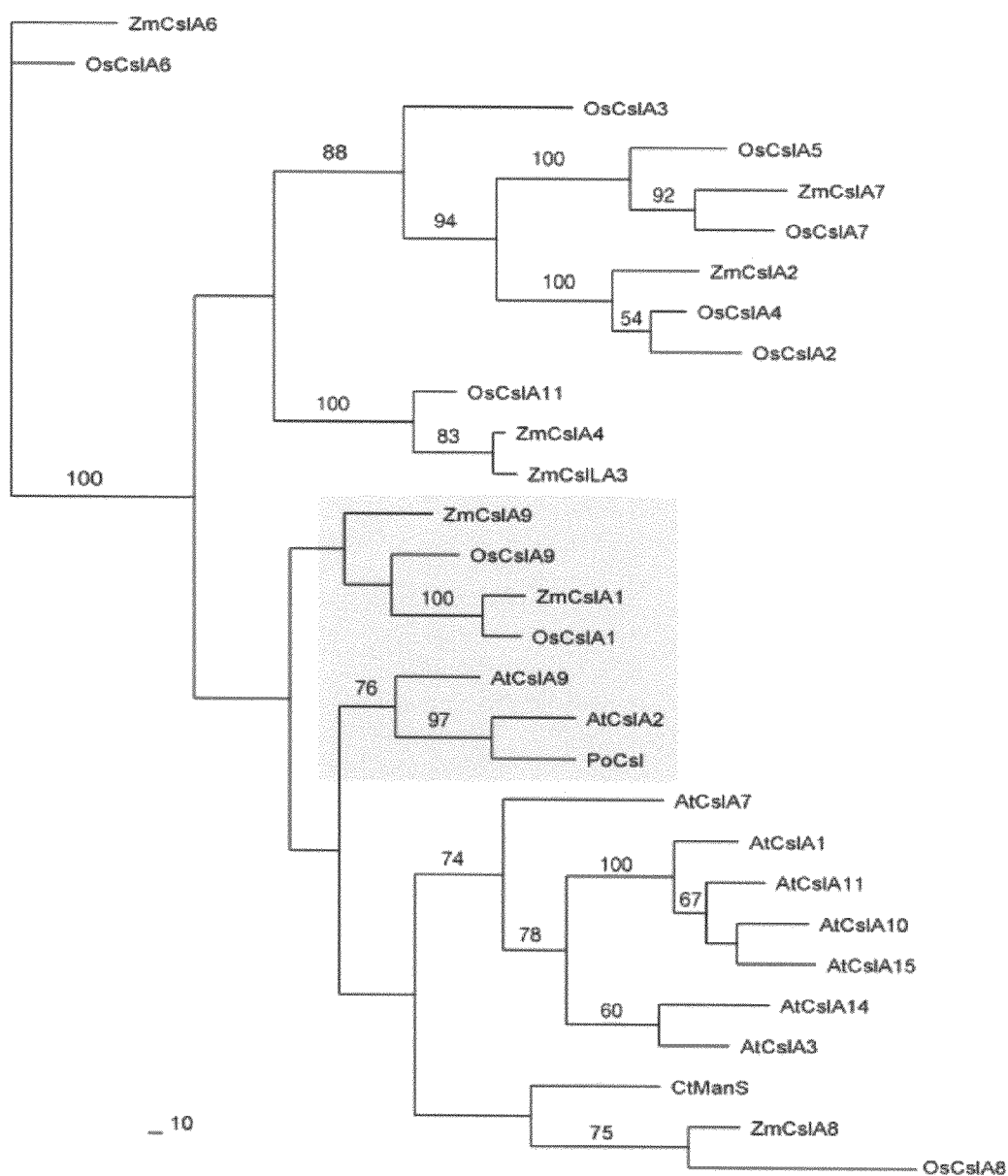
FIG. 4 shows the phylogenetic analysis of CslA protein sequences from *Arabidopsis*, maize, and rice along with the protein of the gene most highly expressed in the psyllium seed coat (PoXylS) and guar seed mannan synthase (CtManS).

Upon phylogenetic analysis of the derived amino acid sequence for the abundantly expressed Csl with the CesA and Csl sequences from *Arabidopsis*, maize, and rice, this sequence tightly clusters with the CslA clade. Upon finer analysis of only the CslA and the psyllium sequence, it forms a sub-clade with the CslA2 sequence of *Arabidopsis* (FIG. 4). The CslA sequences from rice and maize that most closely match the psyllium CslA sequence are CslA1 and CslA9. The guar mannan synthase, CtManS, also forms a clade with the CslA set of sequences as previously reported (Dhugga et al. 2004).

We had previously proposed that the CslA sequences from rice and maize were involved in xylan formation (Dhugga et al. 2004). The fact that the psyllium sequence is phylogenetically most closely related to this set of sequences supports that proposal. The likelihood remains, however, that the same sequence can carry out two enzymatic reactions of mannan and xylan synthases. The most likely scenario is that by itself a given CslA sequence forms mannan as has been demonstrated by the functional expression of these genes in heterologous systems (Dhugga et al. 2004; Liepman et al. 2005). However, in native cells, these genes may carry out the function of xylan synthase for which another component is required. We could not detect elevated xylan synthase activity in the soybean somatic embryos expressing the guar ManS gene, which strongly suggests that a second component is required for the same protein that forms mannan by itself to form xylan (Dhugga et al. 2004).

Because of a lack of success previous to our work in the identification of a xylan synthase, some groups have implicated the involvement of the enzymes annotated as alpha-glycosyltransferases in xylan formation based on mutational genetics studies (Brown D M, Goubet F, Wong V W, Goodacre R, Stephens E, Dupree P, Turner S R. Comparison of five xylan synthesis mutants reveals new insight into the mechanisms of xylan synthesis. Plant J. 2007 Oct. 18; [Epub ahead of print] PMID: 17944810 [PubMed]; Lee C, Zhong R, Richardson E A, Himmelsbach D S, McPhail B T, Ye Z H. The PARVUS gene is expressed in cells undergoing secondary wall thickening and essential for glucuronoxylan biosynthesis. Plant Cell Physiol. 2007 Nov. 8; [Epub ahead of print] PMID: 17991630 [PubMed]). Catalytic polypeptides of beta-glycosyltransferases are known to possess conserved motifs are absent from these proteins that have been proposed to make xylan. It is possible that these polypeptides play a role in the formation of a xylan synthase complex thus affect xylan formation indirectly. Now that we have found a class of highly expressed ESTs from the seed coat of psyllium, which is nearly completely made of arabinoxylan, based on previous knowledge, this class of ESTs, which falls into CslA subfamily, should be designated as xylan synthases. One of the possible solutions to the disparity that some of these genes have previously been reported to make beta-mannan is that the CslA polypeptides by themselves make mannan but in a complex make arabinoxylan (Dhugga et al., 2004; Liepman et al., 2005).

FIG. 4: Phylogenetic analysis of CslA protein sequences from *Arabidopsis*, maize, and rice along with the protein of the gene most highly expressed in the psyllium seed coat and guar seed mannan synthase. The phylogenetic analysis was performed by PAUP as described previously (Dhugga et al. 2004). The numbers (only >50%) along the branches are bootstrap values in percentages obtained from 500 replications with random sequence addition. Rice sequences were downloaded from the TIGR site (world wide web at tigr.org/tigr-scripts/osa1_web/gbrowse/rice/) OsCslA1-LOC_Os02g09930.1; OsCslA2-LOC_Os10g26630.1; OsCslA3-LOC_Os06g12460.1; OsCslA4-LOC_Os03g07350.1; OsCslA5-LOC_Os03g26044.1; OsCslA6-LOC_Os02g51060.1; OsCslA7-LOC_Os07g43710.1; OsCslA9-LOC_Os06g42020.1; OsCslA11-LOC_Os08g33740.1; LOsCslA8-LOC_Os09g39920.1.

*Arabidopsis* sequences were downloaded from the world wide web at cell wall on the Stanford web site. FIG. 5 shows the global alignment of CesA and Csl sequences from multiple species. FIG. 6 shows selected CslA amino acid sequences from several plant species including *Arabidopsis*, maize, and rice along with the sequences of psyllium XylS and guar ManS. The conserved motifs (D, DXD, D, QXXRW) diagnostic of polymerizing b-glycosyltransferases are shown in asterisks.

BIBLIOGRAPHY

Bacic A., Harris P. J. and Stone B. A. 1988. Biosynthesis of plant cell walls. In Preiss J., (ed. Biochemistry of Plants. (Academic Press), New York, pp. 297-371.

Burton R. A., Wilson S. M., Hrmova M., Harvey A. J., Shirley N. J., Medhurst A., Stone B. A., Newbigin E. J., Bacic A. and Fincher G. B. 2006. Cellulose synthase-like CslF genes mediate the synthesis of cell wall (1,3;1,4)-?-D-glucans. Science 311: 1940-1942.

Carpita N. C. 1996. Structure and biogenesis of the cell walls of grasses. Annual Review Of Plant Physiology And Plant Molecular Biology 47: 445-476.

Dhugga, K. S. 2007. Maize biomass yield and composition for biofuels. Crop Sci. 47:2211-2227.

Dhugga K. S., Barreiro R., Whitten B., Stecca K., Hazebroek J., Randhawa G. S., Dolan M., Kinney A. J., Tomes D., Nichols S, and Anderson P. 2004. Guar seed beta-mannan synthase is a member of the cellulose synthase super gene family. Science 303: 363-366.

Edwards S., Chaplin M. F., Blackwood A. D. and Dettmar P. W. 2003. Primary structure of arabinoxylans of ispaghula husk and wheat bran. Proceedings of the Nutrition Society 62: 217-222.

Hasler C. M., Kundrat S, and Wool D. 2000. Functional foods and cardiovascular disease. Current atherosclerosis reports 2: 467-475.

Hazen S. P., Scott C. J. S, and Walton J. D. 2002. Cellulose synthase-like genes of rice. Plant Physiology Rockville 128: 336-340.

Liepman A. H., Wilkerson C. and Keegstra K. 2005. Expression of cellulose synthase-like (Csl) genes in insect cells reveals that CslA family members encode mannan synthases. Proc. Natl. Acad. Sci. USA 102: 2221-2226.

Naghdi Badi H., Dastpak A. and Ziai S. A. 2004. A review of psyllium plant. Journal of Medicinal Plants 3.

Ohr L. M. 2004. Controlling cholesterol. Food Technology 58: 73-76. Pear J. R., Kawagoe Y., Schreckengost W. E., Delmer D. P. and Stalker D. M. 1996. Higher plants contain homologs of the bacterial celA genes encoding the catalytic subunit of cellulose synthase. Proceedings of the National Academy of Sciences of the United States of America 93: 12637-12642.

Pettersson D., Graham H. and Aman P. 1990. Enzyme supplementation of broiler chicken diets based on cereals with endosperm cell walls rich in arabinoxylans or mixed-linked beta-glucans. ANIMAL PRODUCTION 51: 201-208.

Richmond T. A. and Somerville C. R. 2000. The cellulose synthase superfamily. Plant-Physiology-Rockville. [print] October, 2000; 124:495-498.

Saxena I. M., Brown R. M., Fevre M., Geremia R. A. and Henrissat B. 1995. Multidomain architecture of beta-glycosyl transferases: Implications for mechanism of action. J. Bacteriol. 177: 1419-1424.

Veldman A. and Vahl H. A. 1994. Xylanase in broiler diets with differences in characteristics and content of wheat. British Poultry Science 35: 537-550.

Young J. 2002. Global developments in heart benefit foods. Agro Food Industry Hi-Tech 13: 2-3.

Ziai S. A., Larijani B., Akhoondzadeh S., Fakhrzadeh H., Dastpak A., Bandarian F., Rezai A., Badi H. N. and Emami T. 2005. Psyllium decreased serum glucose and glycosylated hemoglobin significantly in diabetic outpatients. Journal of Ethnopharmacology 102: 202-207.

Example 2

Monitoring Expression of Xylan Synthase Genes

Expression of xylan synthase may be monitored by gene or protein fusions with a polypeptide whose enzymatic activity is easily assayed such as, for example, alkaline phosphatase, beta galactosidase, chloramphenicol acetyltransferase, luciferase, green fluorescent protein, beta glucoronidase, or derivatives thereof.

Additional methods to monitor expression includes performing a methylation analysis of polysaccharides from stems of the mutant and the wild type. The concept of this test is that in xylans, the xylose residues are linked through 1,4-linkages. Thus, when the free hydroxyls of xylans are chemically methylated in vitro, followed by hydrolysis of the methylated polysaccharide to free sugars, a large proportion of the partially methylated xylose residues will have free hydroxyls on carbons 1 and 4 (since these were not susceptible to methylation before hydrolysis of the polymer).

Experimentally, bulk cell wall material is isolated from the stems of wild type and mutant plants. Cell wall material is ethanol extracted and subsequently lyophilized. 1.5 g of cell wall material is fractionated into pectic and hemicellulosic fractions, and each will be analyzed by the methods described in the following paragraph. To fractionate pectic materials from hemicellulosic materials, 1.5 g of cell wall material is extracted sequentially with EDTA, ammonium oxalate, and 0.1 M KOH. The supernatants from each of these extractions is combined and designated the pectic fraction. The remaining insoluble cell wall material is extracted with 4M KOH. This treatment extracts hemicellulosic material from cellulose.

The material solubilized by this process is designated the hemicellulosic fraction. Hemicellulosic and pectic fractions is neutralized and dialyzed overnight against water at 40° C. Approximately 3 mg each of the pectic and hemicellulosic fractions is suspended in 1 ml anhydrous DMSO in 15 ml corex tubes capped by serum sleeve stoppers. The tubes are evacuated of oxygen and sonicated at 500° C. to disperse the polysaccharides. The free sugar hydroxyl groups will be converted to lithium salts by the addition of 250 yl of 2.5 M n-butyl lithium (dissolved in hexane) to each tube. This reaction is allowed to proceed for four hours under continuous Ar2 flow. The sugar lithium salts are methylated by the addition of 500 yl Cll3l to each tube. This reaction is allowed to proceed overnight. The organic layers from each reaction mix will be transferred to fresh tubes and evaporated to dryness under a stream of N2. The methylated polysaccharides are hydrolyzed, acetylated and prepared for GC as previously described. Linkages will be deduced by GC-MS analysis of the partially methylated and acetylated alditol acetates. We expect to see a reduction in the content of 1,4 linked xylose residues in the hemicellulosic fraction of Ac39-2 mutant plants.

Example 3

Functional Analyses of ATCSL Genes by Knock-Out/Knock-Down of Multiple Genes by T-DNA Mutant Isolation and/or RNAi Multiple genes encoding CSL proteins are present in *Arabidopsis* genome. Some of these genes might be specific for secondary wall formation and AtCslA2 & ATCslA9 are good candidates due to their high homology to PoCSL (Pysillium CSL, FIG. 4 phylogenetic tree). For functional analyses of these genes, it is very likely that due to functional redundancy one might need to manipulate the expression of multiple CSL genes simultaneously. We propose to knock-out/down multiple CSL genes simultaneously in transgenic plants using RNAi (inverted repeats of the coding sequences or promoter sequences) or T-DNA. An example to target both AtCslA2 and A9 is described here. We analyzed the cDNA sequence of all these 2 CSLs and identified a stretch of high homology regions (FIG. 7). We amplified these regions (highlighted in green in FIG. 8) by PCR from CSLA2 and performed a multi-way ligation to make an inverted repeat using ADH-intron as a spacer. The RNAi cassette of these inverted repeats is driven by a constitutive or vascular bundle/secondary wall specific promoters e.g. UBI and S2A. These vectors are transformed into *Arabidopsis* by *Agrobacterium* mediated 'floral dip' method. The scheme of these final vectors is presented in FIGS. 8A and 8B. We already identified several transgenic lines harboring these 2 vectors. Molecular, biochemical, physiological and phenotypic analyses of these transgenic lines are under way.

Taking a parallel approach for functional analyses of ATCSLA2 and ATCSLA9 genes we also identified the T-DNA knock out mutant for these 2 genes. The positions of T-DNA and molecular analyses of these mutants by gPCR/RT-PCR of atcsla2 and atcsla9 are shown in FIGS. 9 and 10, respectively. The data clearly show that the T-DNAs are inserted in AtCSLA02 and A09 genes. We have identified a homozygous and complete knock-out of these two genes as revealed by genomic PCR and RT-PCR, respectively. Functional, biochemical, physiological and phenotypic analyses of these mutants are under way along with making a double mutant for atcsla2/atcsla9 by crosses.

Example 4

Predicted Topology of PoXyls Protein

The program TMHMM, accessible on the world wide web at cbs.dtu.dk.services, was used to predict the transmembrane domains in the psyllium xylan synthase protein. Five transmembrane domains, one near the N terminus and four near the C-terminus were found, suggesting that the N-terminal end of the protein is in the cytosol.

| # Psyllium_XylS_Protein_full Length: | 534 |
|---|---|
| # Psyllium_XylS_Protein_full Number of predicted TMHs: | 5 |
| # Psyllium_XylS_Protein_full Exp number of AAs in TMHs: | 104.11441 |
| # Psyllium_XylS_Protein_full Exp number, first 60 AAs: | 14.52238 |
| # Psyllium_XylS_Protein_full Total prob of N-in: | 0.05040 |

| # Psyllium_XylS_Protein_full POSSIBLE N-term signal sequence | | | |
|---|---|---|---|
| Psyllium_XylS_Protein_full TMHMM2.0 | outside | 1 | 49 |
| Psyllium_XylS_Protein_full TMHMM2.0 | TMhelix | 50 | 72 |
| Psyllium_XylS_Protein_full TMHMM2.0 | inside | 73 | 361 |
| Psyllium_XylS_Protein_full TMHMM2.0 | TMhelix | 362 | 384 |
| Psyllium_XylS_Protein_full TMHMM2.0 | outside | 385 | 403 |
| Psyllium_XylS_Protein_full TMHMM2.0 | TMhelix | 404 | 426 |
| Psyllium_XylS_Protein_full TMHMM2.0 | inside | 427 | 486 |
| Psyllium_XylS_Protein_full TMHMM2.0 | TMhelix | 487 | 504 |
| Psyllium_XylS_Protein_full TMHMM2.0 | outside | 505 | 508 |
| Psyllium_XylS_Protein_full TMHMM2.0 | TMhelix | 509 | 531 |
| Psyllium_XylS_Protein_full TMHMM2.0 | inside | 532 | 534 |

FIG. 11 shows the five putative transmembrane domains, identified by the TMHMM program, in the psyllium xylan synthase protein. One near the N terminus and four near the C-terminus were found, suggesting that the N-terminal end of the protein is in the cytosol. FIG. 14 shows the novel Psyllium nucleotide sequence of the invention, while FIG. 15 shows the predicted amino acid sequence of the Psyllium xylan synthase of the invention. FIG. 16 shows the Psyllium sequence with the respective conserved residues highlighted. The residues D, DXD, D, and QXXRW (highlighted and underlines in bold red, reading from left to right of the sequence) are conserved across polymerizing beta-glycosyltransferases. In addition, the residues C that is six amino acids upstream of the DXD motif, another C that is one amino acid downstream of the QXXRW motif, and an A that is four amino acids downstream of the QXXRW motif appear to be specific to this class (xylan synthase) of proteins.

Example 5

Particle Gun Transformation and Regeneration of Transgenic Maize Plants

Immature maize embryos from greenhouse donor plants are bombarded with a plasmid containing a polysaccharide synthase sequence of the invention operably linked to a F3.7 promoter (Baszczynski, et al. (1997) *Maydica* 42:189-201) and the selectable marker gene PAT (Wohlleben et al. (1988) *Gene* 70:25-37), which confers resistance to the herbicide Bialaphos. Alternatively, the selectable marker gene is provided on a separate plasmid. Transformation is performed as follows. Media recipes follow below.

Preparation of Target Tissue

The ears are husked and surface sterilized in 30% Clorox bleach plus 0.5% Micro detergent for 20 minutes, and rinsed two times with sterile water. The immature embryos are excised and placed embryo axis side down (scutellum side up), 25 embryos per plate, on 560Y medium for 4 hours and then aligned within the 2.5-cm target zone in preparation for bombardment.

Preparation of DNA

A plasmid vector comprising a nucleotide sequence of the invention operably linked to a F3.7 promoter is made. This plasmid DNA plus plasmid DNA containing a PAT selectable marker is precipitated onto 1.1 μm (average diameter) tungsten pellets using a $CaCl_2$ precipitation procedure as follows:

100 μl prepared tungsten particles in water
10 μl (1 μg) DNA in Tris EDTA buffer (1 μg total DNA)
100 μl 2.5 M $CaCl_2$
10 μl 0.1 M spermidine Each reagent is added sequentially to the tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol, and centrifuged for 30 seconds. Again the liquid is removed, and 105 μl 100% ethanol is added to the final tungsten particle pellet. For particle gun bombardment, the tungsten/DNA particles are briefly sonicated and 10 μl spotted onto the center of each macrocarrier and allowed to dry about 2 minutes before bombardment.

Particle Gun Treatment

The sample plates are bombarded at level #4 in particle gun #HE34-1 or #HE34-2. All samples receive a single shot at 650 PSI, with a total of ten aliquots taken from each tube of prepared particles/DNA.

Subsequent Treatment

Following bombardment, the embryos are kept on 560Y medium for 2 days, then transferred to 560R selection medium containing 3 mg/liter Bialaphos, and subcultured every 2 weeks. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to the lighted culture room. Approximately 7-10 days later, developing plantlets are transferred to 272V hormone-free medium in tubes for 7-10 days until plantlets are well established. Plants are then transferred to inserts in flats (equivalent to 2.5" pot) containing potting soil and grown for 1 week in a growth chamber, subsequently grown an additional 1-2 weeks in the greenhouse, then transferred to classic 600 pots (1.6 gallon) and grown to maturity. Plants are monitored and scored for altered polysaccharide synthase activity.

Bombardment and Culture Media

Bombardment medium (560Y) comprises 4.0 g/l N6 basal salts (SIGMA C-1416), 1.0 ml/l Eriksson's Vitamin Mix (1000×SIGMA-1511), 0.5 mg/l thiamine HCl, 120.0 g/l sucrose, 1.0 mg/l 2,4-D, and 2.88 g/l L-proline (brought to volume with D-I $H_2O$ following adjustment to pH 5.8 with KOH); 2.0 g/l Gelrite (added after bringing to volume with D-I $H_2O$); and 8.5 mg/l silver nitrate (added after sterilizing the medium and cooling to room temperature). Selection medium (560R) comprises 4.0 g/l N6 basal salts (SIGMA C-1416), 1.0 ml/l Eriksson's Vitamin Mix (1000×SIGMA-1511), 0.5 mg/l thiamine HCl, 30.0 g/l sucrose, and 2.0 mg/l 2,4-D (brought to volume with D-I $H_2O$ following adjustment to pH 5.8 with KOH); 3.0 g/l Gelrite (added after bringing to volume with D-I H₂0); and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I H₂0) (Murashige and Skoog (1962) *Physiol. Plant.* 15:473), 100 mg/l myo-inositol, 0.5 mg/l zeatin, 60 g/l sucrose, and 1.0 ml/l of 0.1 mM abscisic acid (brought to volume with polished D-I H₂0 after adjusting to pH 5.6); 3.0 g/l Gelrite (added after bringing to volume with D-I H₂0); and 1.0 mg/l indoleacetic acid and 3.0 mg/l bialaphos (added after sterilizing the medium and cooling to 60° C.). Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL, and 0.40 g/l glycine brought to volume with polished D-I H₂0), 0.1 g/l myo-inositol, and 40.0 g/l sucrose (brought to volume with polished D-I H₂0 after adjusting pH to 5.6); and 6 g/l bacto-agar (added after bringing to volume with polished D-I H₂O), sterilized and cooled to 60° C.

Example 6

*Agrobacterium*-Mediated Transformation of Maize

For *Agrobacterium*-mediated transformation of maize with polysaccharide synthase gene(s) or nucleotide sequence(s) of the invention, preferably the method of Zhao is employed (U.S. Pat. No. 5,981,840, and PCT patent publication WO98/32326; the contents of which are hereby incorporated by reference). Briefly, immature embryos are isolated from maize and the embryos contacted with a suspension of *Agrobacterium*, where the bacteria are capable of transferring the polysaccharide synthase gene(s) or nucleotide sequence(s) to at least one cell of at least one of the immature embryos (step 1: the infection step). In this step the immature embryos are preferably immersed in an *Agrobacterium* suspension for the initiation of inoculation. The embryos are co-cultured for a time with the *Agrobacterium* (step 2: the co-cultivation step). Preferably the immature embryos are cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformants (step 3: resting step). Preferably the immature embryos are cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). Preferably, the immature embryos are cultured on solid medium with a selective agent resulting in the selective growth of transformed cells. The callus is then regenerated into plants (step 5: the regeneration step), and preferably calli grown on selective medium are cultured on solid medium to regenerate the plants. Regenerated transgenic plants are then monitored for altered polysaccharide synthase activity.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended embodiments.

SEQUENCE LISTING (107 sequences)

SEQ ID NO: 1 - DNA, 1983 bp, Plantago psyllium
ccattactcactagctactactagctccactcccggccctttctctctctctctactctctctctcttctgctccgcaatgccgcagtacttctccatccttgtataatcatcggattgagcattactcggcttaataagggtagcagaaatcaagagagagattaaagaagacctttaagaaataaaacaaaaaaaaaattaaataatttctcattaccatcctcagatccaatggctgaggtttccggtaagagtttcctccctgaatctctaccgggatacaaccctgacattaccggccaaatcggtctcctatgggagctcatcaagacgccgttgattatccctgtcttgaggctgtctgtgtacatttgcttggcaatgtcgataatggtgttcatggagaggctttatatgggtgttgttattgttctcgtgagattgttctggaagaagcctgagcagcgctacaaatgggagcctatggaggacgacattgaggatgctaatgctgcttatcccatcgtcctcgttcagatccccatgttcaacgagcgagaggtctacaagatctcaattggtgcggcgtgtaatctttcatggcctgctgataggctggtgattcaagtactggatgattccactgatttcacaatcaaggacttggttgagaaagaatgccttaggtgggctagcaaaggtattaacattcggtaccaaattagagaatcgcgaggcggatacaaagccggtgcactcaaagaagggttgaagcacgaatatgtcaaaccgtgtgaatacgtagtcatctttgacgctgacttccgcccggaacccgattttctcaaacgtgccgtcccgtttctaatccacaacaaggacattgccctcgttcagtcccgatggagattcgtgaattcagacgagtgcttgttgacaagaatgcaagaaatgtcactggactaccatttcactgttgagcaagaagttggatcagcaacgcatgccttttttggtttcaatggaactggtggtatctggagaattaaagccattaatgaagctggtggatggaaggacagaaccacggtagaggatatggatcttgctgttcgtgctggtctgaaaggctggaaatttctttacttgggagaccttcatgtgaaaagtgaacttcctagtactttcaaggccttccgtttccagcagcacaggtggtcatgtggtcctgctaatttgttcaggaagatggtgtttgatattgctacaaacaagaaagtcacattgtacaagaagttttacgtgatctacagcttcttctttgtccgaaagatcattgcccacatgttcaccttcttcttttactgtgtggttcttcccttgacatgccttgttcctgaggtagaggtgccaaagtggggagccatttatcttccttgcattatcaccgtccttaactcagtcggaactccaaggtcattccatctgttgttctattgggttttattcgagaacgtcatgtctttccaccgcaccaaggccacaatcatcggtctgctagaagctgcaagagttaatgaatgggttgtcactgaaaagcttggagacgctctcaagaacaaatccaaatcagctgcaccaaggagatcattgaccaaaatactaggagacagaattcaattacaagagttgggatttgcagtatttcttttcatctgtggatgtttcgactatgtatacggaaagaactactacttcgtatacttttggctccaagttgtcacctttacaattgcgggatttggctacattggcacaatagtcccaagccattaaacagcagcagtaggaaggagtcacgcgtgggaaaagtaccaagtacaactcaaattcctgtatttttagccttatacaacatatgtacacaagattgatatgtccgatgcttctggtcaattattccttagccggaaaacaaaaa

SEQ ID NO: 2 - protein, 534 aa, Plantago psyllium
MAEVSGKSFLPESLPGYNPDITGQIGLLWELIKTPLIIPVLRLSVYICLAMSIMVFMERLYMGVVIVLVRLFWKKPEQRYKWEPMEDDIEDANAAYPIVLVQIPMFNEREVYKISIGAACNLSWPADRLVIQVLDDSTDFTIKDLVEKECLRWASKGINIRYQIRESRGGYKAGALKEGLKHEYVKPCEYVVIFDADFRPEPDFLKRAVPFLIHNKDIALVQSRWRFVNSDECLLTRMQEMSLDYHFTVEQEVGSATHAFFGFNGTGGIWRIKAINEAGGWKDRTTVEDMDLAVRAGLKGWKFLYLGDLHVKSELPSTFKAFRFQQHRWSCGPANLFRKMVFDIATNKKVTLYKKFYVIYSFFFVRKIIAHMFTFFFYCVVLPLTCLVPEVEVPKWGAIYLPCIITVLNSVGTPRSFHLLFYWVLFENVMSFHRTKATIIGLLEAARVNEWVVTEKLGDALKNKSKSAAPRRSLTKILGDRIQLQELGFAVFLFICGCFDYVYGKNYYFVYFWLQVVTFTIAGFGYIGTIVPSH

SEQ ID NO: 3 - DNA, 1976 bp, Zea mays
cccacccccctacccccgcggcgccgccggagccagagcgagagcgatggacgcgctgccggaggcgtggtcgcaggtgcgcgcgccggtgatcgtgccgctgctgcggctggcggtggccgtgtgcctcaccatgtcggtgcttctgttccttgagcgcgtgtacatggccgtcgtcatctccggggtgcgcctgctccgcctccgccccgaccgccgctaccgctgcgaccccctccccgaggacgacccggagctgggctcctccgcgttccccgtcgtgctcgtccagatccccatgttcaacgagcgcgaggtgtaccagctgtccatcggcgccgtgtgcgggctgtcgtggccggcggaccggctggtggtgcaggtgctcgacgactccacggacgaagtgattaagcaggagatggtgcggatggagtgcgagcggtgggctcggaaggggatcaacataacgtaccagatccgggaggaccgcaaggggtacaaggccggcgcgctgcgggcggggatgaggcacgcgtacgtgcgcgactgcgagtacgtggccatcttcgacgccgacttccagcccgacccggactacctcaagcgcaccatcccctacctcgtccacaacccggagatcgccctcgtccaggcgcgctggagattcgtgaacgcggacgagtgcctgatgacgaggatgcaggagatgtccctggactaccacttcaccgtggagcaggaagtgagctcctccgtctgcgccttctttggattcaacggcaccgccggcgtgtggcgcatctccgcggtgaacgaggctggggggtggaaggaccggaccacggtggaggacatggatctggccatccgggccagcctcaagggctggaagttcgtctacctcggtgacgtccaggtgaaaagcgagctgccgagtaccttcaaggccttccggttccagcagcacaggtggtcgtgcggcccggcgaacctgttcaggaagatgctcatggagattgtgacgaacaagaaagtgacgatctggaagaagatccacgtcatctacaacttcttcctgatacgcaagatcatcgcgcacatcatcaccttctcgttctactgcgtcatcatcccggcaaccatcttcgtccccgaggtccgcatacccaagtggggctgcgtctacatcccctcggccatcaccctcctcaactctgtcggcactcccaggtctttccacctgcttttcttctgggtcgccttcgagaacgtcatgtccctgcacagaacaaaggccacgctgatcggcttgctggaggccggcagggccaacgagtgggtggtgacggcgaagctcggcagcgccatgaagatgaaatcggctaacaaagcggggctcaggaagcagttcatgaggatatgggagaggctgcacgtcacggagctcggggtggcagccttcctcttctcctgcggctggtacgatcttgcgtacgggagggaccatttcttcatctacctcttcttccagtctgtcgcgtttttcatcgtcggcgtcggctacgtcggcaccatcgtcccgcagtcgtagcggaagcgtgtccagatcatccgcttctctctggttttcgcattgtgtcttgggtaagtttcgtagtggatgaccggtttgaggtaaagatcatgcatgcggtcctctcttccatcgtctttttttggggaccggccgtgtgtgcttcgtcgaccttcggctgcatgcgcggtgttttactgtaaaataggaaagcagtgttgcaagatcgctgcaggagaatttagagattggtgccacatgggcaggagatgtcctggtgtttctgcttatatgctatatcaactatgtgatgtgttttaagggggggtgcaggatggctgcttccaatgtactagtaacatacagagaaacaggttcagacatgtgttcagaaaaaaaa

SEQ ID NO: 4 - protein, 515 aa, Zea mays
MDALPEAWSQVRAPVIVPLLRLAVAVCLTMSVLLFLERVYMAVVISGVRLLRLRPDRRYRCDPLPEDDPELGSSAFPVVLVQIPMFNEREVYQLSIGAVCGLSWPADRLVVQVLDDSTDEVIKQEMVRMECERWARKGINITYQIREDRKGYKAGALRAGMRHAYVRDCEYVAIFDADFQPDPDYLKRTIPYLVHNPEIALVQARWRFVNADECLMTRMQEMSLDYHFTVEQEVSSSVCAFFGFNGTAGVWRISAVNEAGGWKDRTTVEDMDLAIRASLKGWKFVYLGDVQVKSELPSTFKAFRFQQHRWSCGPANLFRKMLMEIVTNKKVTIWKKIHVIYNFFLIRKIIAHIITFSFYCVIIPATIFVPEVRIPKWGCVYIPSAITLLNSVGTPRSFHLLFFWVAFENVMSLHRTKATLIGLLEAGRANEWVVTAKLGSAMKMKSANKAGLRKQFMRIWERLHVTELGVAAFLFSCGWYDLAYGRDHFFIYLFFQSVAFFIVGVGYVGTIVPQS

SEQ ID NO: 5 - DNA, 1671 bp, Zea mays
catggagttggaggggccgtgggcgcgggtgctgcacctgcacgatgcgtgcgagtggggccgggcggtgcgggcgcgcgcggtggcgccggcgctggaggccgcggcgtgggcgtgcctcgccatgtcggtcatgctcgtgctcgaggtgtgctacatgagcgtctccagcttcgtcgccgtcaacctgctgcgccggaccccacagcggcggtacagctgggagcccatgccctccgggaccgcccggggggacgatgaggaggcagcggtgggcgatggaggcggcgaggcgtacccgatggtactcgtgcagatccccatgtacaacgagagggaggtctacaagatctctattggagcggcatgtgccctcacatggccgcccgaccgtattataatccaagtattggatgattccaccgacccattcattaaggaacttgtggagtttgaatgcaaggattgggccagcaagaaaatcaacataaaatatgaaattcgggaaagtaggaagggatacaaagcaggagccctgaagaagggcatggaacatagttacgcccaagaatgtgattttgttgccatctttgatgcagattttcaacctgatccggacgtccttttaagaactataccatttcttgtgcataacccgaagattgctctagtacagacacgttgggagtttgtgaactacaatatttgcctactgacaaggatacagaagatgtcactagattatcattttaaggtagagcaggaatcagggtcatctgtgcatgccttctttggtttcaacggtacggctggcgtgtggcgggtatcagctatcggtgaagcaggaggatggaaggatcgcaccactgtggaagacatggacttggctgtgcgggcaagcctcaagggatggcagttcctgtatgttggtgatataagggttaagagtgaactcccaagtactttcaaggcctaccgtcatcaacagcacaggtggacttgtggtgctgccaacctcttcaggaaaatggccggggacattgttataagcaagggggcgactgtatggaagaagcttcaccttctgtacagcttcttcttcgtccgaagggtcatcgctcccatcctaacgttcctgttctactgcgtcgtgatcccactgtctgtcatggtccccgaagtcagcatccctgcctggggaatgttctacattcccactgccatcaccatcatgacagccatcaggaatccttggtctatccatctggtgccaatatggatcctgttcgagaacgtcatgtccatgcaccgaatgcgcgcggcgctgacggggctgctggagaccacgtacgtggacgagtgggtggtcaccgagaaggtgggcgatcatgtgaaggacaagctcgaggtccctctccttacaccggtgaagccaaccgagtgcgtcgagaggatctacttgcctgagctcctggtcgcgttctacctgttgctatgcgcgtcgtacgatgtcgtgctcggagccgggcactactacccgtacatcttcctccaggccttcgctttcctcgtgctggggtttggcttcgccggcaccgtgacgccctgctcttgttcataagccatcgcgcgcatagcgctagcgcccatggctattttgctgcattcttc

SEQ ID NO: 6 - protein, 539 aa, Zea mays
MELEGPWARVLHLHDACEWGRAVRARAVAPALEAAAWACLAMSVMLVLEVCYMSVSSFVAVNLLRRTPQRRYSWEPMPSGTARGDDEEAAVGDGGGEAYPMVLVQIPMYNEREVYKISIGAACALTWPPDRIIIQVLDDSTDPFIKELVEFECKDWASKKINIKYEIRESRKGYKAGALKKGMEHSYAQECDFVAIFDADFQPDPDVLLRTIPFLVHNPKIALVQTRWEFVNYNICLLTRIQKMSLDYHFKVEQESGSSVHAFFGFNGTAGVWRVSAIGEAGGWKDRTTVEDMDLAVRASLKGWQFLYVGDIRVKSELPSTFKAYRHQQHRWTCGAANLFRKMAGDIVISKGATVWKKLHLLYSFFFVRRVIAPILTFLFYCVVIPLSVMVPEVSIPAWGMFYIPTAITIMTAIRNPWSIHLVPIWILFENVMSMHRMRAALTGLLETTYVDEWVVTEKVGDHVKDKLEVPLLTPVKPTECVERIYLPELLVAFYLLLCASYDVVLGAGHYYPYIFLQAFAFLVLGFGFAGTVTPCSCS

SEQ ID NO: 7 - DNA, 1795 bp, Zea mays
gatttggtggagacggaatgccaaagatggaagagcaaaggcgtgaatataaagtacgaggtgagggggaaccggaaggggtacaaggccggcgcgctcaaggaaggactgaagcatgactacgtcgaagactgcgagtacatcgccatgttcgatgctgacttccagcccgagcctgatttcctcctaagggctgtcccattccttgtgcataacccggagatcgccctcgtccaagctcgctggaaattcgttaattctggtgagtgtctgctgacgagattccaagaaatgtccttggactaccatttcaagtatgagcaagaggcaggctcctcactgcattcattctttggcttcaatgggacagccggtgtctggaggattgcagctatcgatgacgccgggggctggaaggaccggacgacggtggaggatatggacctggctgtccgtgcgatgctgcagggctggaagtttgtttacgtcggcgacataaaagtcaagagtgaattgcctagcacgttcaaggcataccggtttcagcagcacaggtggtcttgtggaccggcaaacctgttcaagaaaatgatggtagagattttagaaaacaagaaagtgtcattgtggagcaaaatctacttatggtacaatttcttcttcgttgggaaggtcgctgcccacacggtgacattcatctactactgctgtgcgatccccgtgtctgttttgcttcctgagattcagatacctctctggggagttgtctatatcccgacgctcataaccctcttgaaggctcttggcacaccaagttcgtttcacctggtgatcctctgggttctgtttgagaatgtcatgtcactgcaccggattaaagctgcagcaagtggtcttctggatgctggtggacgagtcaatgagtgggttgtcaccgagaagttgggcgacaccagcaaggcaaagcctggcgccaatggatcagatgatgtaaaggtgatagatgtaaagctaacagaacccctcgttcccaagctagtgaagaggcgagcaagattttgggagaggtacaactgctcagaacttttcgttggaacctgcatacttctgtgtggtttctatgacttgctttttgcaaagaagggatactacatttttctcttccttcaaggcacggctttccttgttgttggctttgggtatgtcggcacactacctcattgcaatgcataagctggcatggacaattcatataccttcttactagaaacagatcaagcaaagttcctctctcctgcccatatggaacttcaatgatagttgagcaatattcccatgatcagtcttggccagacatgattcactgccaagaaggttgttcagatgtcgtcgtcactcttctgtcagtctttattgtcaagaaggccattcaaatagtgtcaccgttccaaatttataataacagtgtttactgaagcatcatgacatacaagaatgattggtgcagcagcatttagtaaacatcccgtagagatgcagttcacagtcgtgaaagaactgcagctgctgtaaatggaatagcaccagttgccaatttctgtagatctccgaacttttttttggaaattttgtgatattactcagagttcagatcaataatggaagattgttggcttcctcagttcataacctgtgtatgcttaaaacttgtaaatgtaaattgttattgacactaataattttgtcgaacccaggcagttcttgaaatgcaaatgtagcatgcaaattttttttt

SEQ ID NO: 8 - protein, 410 aa, Zea mays
DLVETECQRWKSKGVNIKYEVRGNRKGYKAGALKEGLKHDYVEDCEYIAMFDADFQPEPDFLLRAVPFLVHNPEIALVQARWKFVNSGECLLTRFQEMSLDYHFKYEQEAGSSLHSFFGFNGTAGVWRIAAIDDAGGWKDRTTVEDMDLAVRAMLQGWKFVYVGDIKVKSELPSTFKAYRFQQHRWSCGPANLFKKMMVEILENKKVSLWSKIYLWYNFFFVGKVAAHTVTFIYYCCAIPVSVLLPEIQIPLWGVVYIPTLITLLKALGTPSSFHLVILWVLFENVMSLHRIKAAASGLLDAGGRVNEWVVTEKLGDTSKAKPGANGSDDVKVIDVKLTEPLVPKLVKRRARFWERYNCSELFVGTCILLCGFYDLLFAKKGYYIFLFLQGTAFLVVGFGYVGTLPHCNA

SEQ ID NO: 9 - DNA, 1678 bp, Zea mays
tcaacgctgatgagtgcatcctcacgcgcatccaggagatgtccctcaactaccacttcgccgtggagcaggaggtgggctccgcctgccacgccttcttcggcttcaacggcacggccggggtgtggcgcgtcgccgcgctggcggacgcgggcggctggaaggagcgcaccaccgtggaggacatggacctggccgtgcgcgctagcctccgcggctggcgcttcgtctacgtgggcgacctggtcgtgcgcaacgagctgcccagcaccttcaaggcgtaccgctaccagcagcaccggtggtcgtgcggcccggccaacctattccgcaaggtgctccctgagatcctccgcagcgaccgggtgtcgctggggaagaagttccacctcctctatgccttcttcttcgtcaggaaggtggtggcgcatctcgtcaccttcctcttctactgcgtcgtcatcccggcctgcgtgctggtgcagggagacgtgcgcctgcccaagtatgtggccatgtacgtgccggcgctcatcacgctgctcaacgccgcctgcacgcccaggtcctgccacctgctcatcttctggatcctcttcgagaacgtcatgtccatgcaccgctctaaggccgccatcatcggcctgctggaggccagccgcgccaacgagtgggtggtcaccgacaagctcggcagtagcaaggcagctgcggctgtagtcgcgaagaagaagaaacagcagctggtccggagcaggtgctgcagcacgagacgggagatgcatgtgctggagctcgcgatgggggtgtgcttgctctattgcgctgtctacgacattgtcttctttggccgcgaccactactacatgtacctactcctgcaatcggcggcggcctttatcgtcggcttcggctacgttggcaccacgacaccctcctgactctcatgagagtcaccaacacagccagacgactgtcagtgcctgtgatccaaattaaagtcataatatttcattaaattattcgtagccttaattgtatcgatcgcatgggcaatagtcatgataaatcaggtttttttatagtactacattaaagggaaaaacagattcaacaaaaacaaaacaaaaaaaggcttcctagagccaagctggacctcagtacactgtaggctttacgttaatgtgtcatgtatacttccagtcaaatgaacatgtacttgctagctagctagctagctagctggctcatgtattctgaatgaatatgatttgttcttattacaggcatacagcagcaaaactttactaattgaacacaaaaggaaggcatacaacaggcattcagcagccacttctcatcctatcaaattccctccacctaaatctgccatcccagctgagagtagagtgtttgaggagcctccaagagccccacctcaaaaacaagtgtggttgtccaaacctaaccatctaaagaagccacttgatactttgcccgatatctctagtgatcccctttctagagcaccacagccacccaagatgaccctttcccacaaaaagactccgcctaagagagaggtgaggtaccactaagagtattcacttggttgtgttttgttaggaggaagagatatgcgagagagcagtagggacatgcaacaatcttctcatga

SEQ ID NO: 10 - protein, 312 aa, Zea mays
NADECILTRIQEMSLNYHFAVEQEVGSACHAFFGFNGTAGVWRVAALADAGGWKERTTVEDMDLAVRASLRGWRFVYVGDLVVRNELPSTFKAYRYQQHRWSCGPANLFRKVLPEILRSDRVSLGKKFHLLYAFFFVRKVVAHLVTFLFYCVVIPACVLVQGDVRLPKYVAMYVPALITLLNAACTPRSCHLLIFWILFENVMSMHRSKAAIIGLLEASRANEWVVTDKLGSSKAAAAVVAKKKKQQLVRSRCCSTRREMHVLELAMGVCLLYCAVYDIVFFGRDHYYMYLLLQSAAAFIVGFGYVGTTTPS

SEQ ID NO: 11 - DNA, 1713 bp, Zea mays
gagcagtgcctgaacccaagtgcagtgcagcagccatgggagcagcagcagcaggtggccacgcgctgcgcgccgtcggcgacgtcgtctcgttccccgcgaccgtcgccgccttcgtggaggcgctgctccagggctgggccgaggccagggccgggctgctggtgccgctgctccgcgccgcggtgctgctgtgcacggccatgtcgctgatcgtgctggccgagaaggtgttcctgggcgcggtcagctccgtggcgaagctgcggcgccggcgtccggggcgggtgtgcaggtgcgaccccgacgaggaggcggctgcggcatcccaggcctatcccatggtgctcgtccagatccccatgtacaacgagagggaggtttaccagctatcaatagaggcagcctgcaggctcacatggccggtagatcgactaatagtgcaggtgctggacgactccaccgactccgtcatcaaggagctggtgaagggcgagtgcgagcggtgggccacggaggaggggatcaacgtcaagtacgagacgcgcaaggacagggccgggtacaaggccggcaacctcaaggaggggatgcgccacgcctacgtgcgcgcctgcgagttcgtcgccatgttcgacgcagacttccagccgccgccggacttcctcgtcagaaccgtcccgttcctcgtccacaaccccagcctcgcgctcgtgcagacacgctggaagttcgtgaatgccaacgactgcttgctgacgagaatgcaggagatgtccatggactaccatttcaaggtggagcaggaagctggctcttccttatgcaacttctttggatacaacggaaccgctggagtatggagaacgcaagcgatcgtcgagtccgggggctgggaggaccgaaccactgctgaggacatggacttggcgctgagagcagggctcctgggctgggagttcgtctacgttggaagcataaaggttaagagtgagctgccgagcactctcaaggcgtaccggtcccagcagcaccgctggtcatgcggacctgccctcctgttcaagaaaatgttctggcaaattctcgctgccgagagagtgtcggtctggaagaagtggtacatggtctatgacttcttcattgcccggagaatcgtaggcaccttctacacgttcttctttttcagcgtcctgattcctctgaacattctgctacccgaagcgcagattcctgtgtgggagctcatctatatccccatagctatcactcttctcaactctgttgggactccaaggtctatccatctggtcatactgtgggtcttgttcgagaacgtaatggcgttgcatcggtttaaagccatcttgatagggtttctcgaagctgacagggccaacgaatggatcgtgacgcaaaagctggggaatctgcagaagctgaaatcgatcgccagacttacaggaagctaccgtttcaaagacaggttccatttcctggaggtgttcattgggctgttccttttggcctctgcgtgctttgactacttatacagagatgactatgtttacctctttgttcttccccaatcgatcatgtatttcgcgattgggtttcagttcgttggtctcaatgtctctgaagactgaccaattgcaagacaactgaacgttttggttgcgatattatgattgctcgggtcaaggttcttgt

SEQ ID NO: 12 - protein, 537 aa, Zea mays
MGAAAAGGHALRAVGDVVSFPATVAAFVEALLQGWAEARAGLLVPLLRAAVLLCTAMSLIVLAEKVFLGAVSSVAKLRRRRPGRVCRCDPDEEAAAASQAYPMVLVQIPMYNEREVYQLSIEAACRLTWPVDRLIVQVLDDSTDSVIKELVKGECERWATEEGINVKYETRKDRAGYKAGNLKEGMRHAYVRACEFVAMFDADFQPPPDFLVRTVPFLVHNPSLALVQTRWKFVNANDCLLTRMQEMSMDYHFKVEQEAGSSLCNFFGYNGTAGVWRTQAIVESGGWEDRTTAEDMDLALRAGLLGWEFVYVGSIKVKSELPSTLKAYRSQQHRWSCGPALLFKKMFWQILAAERVSVWKKWYMVYDFFIARRIVGTFYTFFFFSVLIPLNILLPEAQIPVWELIYIPIAITLLNSVGTPRSIHLVILWVLFENVMALHRFKAILIGFLEADRANEWIVTQKLGNLQKLKSIARLTGSYRFKDRFHFLEVFIGLFLLASACFDYLYRDDYVYLFVLPQSIMYFAIGFQFVGLNVSED

SEQ ID NO: 13 - DNA, 1833 bp, Zea mays
aaccaccacaccaccacccaatggaggccggggaaatcggcggggcccttgtcttcatcctcgccgccgccgccgccgtcgcggccgccgtgtccgtcggcgcggtcgacttcagccgcccgctcaccgcgggggcgccgttcgacttccaggcggcggtgtcctggctcatcggcatcctcgacggcacgtcctcggcagcggcggacgtggacggggcgtgggtggcggtgcgggccggggtgatcgcgccggtgctgcaggtggcggtgtgggcgtgcatggtgatgtcggtgatgctggtggtggaggccgtgtacaacagcgtcatcagcctcggcgtcaaggccattgggtggaggcctgagtggaggttcaagtggaagcccctcgacagcgccgacgaggagaaggggaccgcccacttccctatggtcctggttcagatacccatgtacaacgagctggaggtgtacaagctgtcaatagcggcagcatgtgagctgcagtggccaaaggacaggatagtaattcaagtgttggacgattctactgacccctttatcaagaatttggtggagcttgaatgtgagcactgggtgaacaaaggtgtcaatattaagtatgccacaagaaccagccgcaagggattcaaggcaggagctctgaagaaaggaatggaatgtgactatgcatggcaaagcgaatacattgctatatttgatgctgatttccaacctgaaccagattttctgctccaaactgtcccattccttctgcacaatccagaagttgcacttgttcaagctcggtggtccttcgtgaatgacacgacaagcctgctgacaagggtacaaaagatgttttacgactaccacttcaaagttgaacaagaagcaggatcagcgacctttgccttcttcagtttcaacggaactgctggagtgtggcgtacaggagccataagagatgcaggaggttggaaggaccgaactacagttgaagacatggacttggcggttcgagcaacactaaagggctggaaattcgtatatgttggagacgttagagtcaagagtgaactgccgtccacttacaaggcctgtcggcagcaattccggtggtctagtggtggtgcaaacttattccgtaagatggcaaaggatgttttgtttgccaaggatatatcactcgtcaagaagttctatatgctctatagcttcttctttgtgaggagagttgtagcgccgacggctgcctgtattctctacaatgtcatcatccccatctcagtcacaatcccggagctttacctaccagtgtggggtgttgcctatattcccatggtgcttaccgtggtcacagctataagacatccaaaaaatctacacatactgccattttggattttgtttgagagtgtgatgacattgcatcggatgagggctgcgatgactggactgctggagctagaaggattcaaccagtggattgtgacaaagaaggtggggaatgatctcgaggacactgaagttcctttgcttcagaaaacccggaaaaggctgagagacagagtcaatctccccgagattggattttcggtgtttctcttcctctgtgcatcatacaacctggtgttccatgggaaaacaagctactacttatatatgtaccttcaggggttagcatttctgttactagggtttaacttcactggcaattgttcttgctaccaatgatagcatgtcaaagctgtacgaattgctgattgatattcattttctggtcatgcgttcgtaaaaaaaaaaaaaaaaaaaaaaaaaaaaaaaaaaa

SEQ ID NO: 14 - protein, 572 aa, Zea mays
MEAGEIGGALVFILAAAAAVAAAVSVGAVDFSRPLTAGAPFDFQAAVSWLIGILDGTSSAAADVDGAWVAVRAGVIAPVLQVAVWACMVMSVMLVVEAVYNSVISLGVKAIGWRPEWRFKWKPLDSADEEKGTAHFPMVLVQIPMYNELEVYKLSIAAACELQWPKDRIVIQVLDDSTDPFIKNLVELECEHWVNKGVNIKYATRTSRKGFKAGALKKGMECDYAWQSEYIAIFDADFQPEPDFLLQTVPFLLHNPEVALVQARWSFVNDTTSLLTRVQKMFYDYHFKVEQEAGSATFAFFSFNGTAGVWRTGAIRDAGGWKDRTTVEDMDLAVRATLKGWKFVYVGDVRVKSELPSTYKACRQQFRWSSGGANLFRKMAKDVLFAKDISLVKKFYMLYSFFFVRRVVAPTAACILYNVIIPISVTIPELYLPVWGVAYIPMVLTVVTAIRHPKNLHILPFWILFESVMTLHRMRAAMTGLLELEGFNQWIVTKKVGNDLEDTEVPLLQKTRKRLRDRVNLPEIGFSVFLFLCASYNLVFHGKTSYYLYMYLQGLAFLLLGFNFTGNCSCYQ

SEQ ID NO: 15 - DNA, 1962 bp, Zea mays
cccgtggtgctggtgcagatccccatgtacaacgagcgggaggtgtacaagctgtcgatcggggcggcatgtgcgctggagtggccgccggagcgcttcgtgatccaggtgctggacgactccacggaccccgttgacctggtggagacggagtgccagaggtggaagagcaaaggcgtgaacataaagtacgaggtgagggggaaccggaaggggtacaaggccggcgcgctcaaggaaggactgaagcacgactacgtcgcagactgcgaatacatcgccatgttcgacgccgacttccagcctgactctgacttcctcctcaggactatcccgttcctcgtgcacaacccggagatcgccctcgtccaggctcgctggaagtttgttaattctgacgagtgtctgctgacaagattccaagagatgtcgttggactaccatttcaagtatgagcaagaggccggctcctcggtgtattcattctttggcttcaatgggacagctggtgtctggaggatctcagcgatcgatgatgctgggggctggaaggaccggacgacagtggaagatatggacctggctgtccgtgcgatgctgcagggatggaagttcctttacgtcggcgacattaaggtcaagagcgaactgcctagcacattcaaggcgtaccggtttcagcagcacaggtggtcatgtgggccggcgaacctgttcaagaaaatgatggtagagattttagaaaacaagagagtgtcgctgtggagtaaaatccacctatggtacgatttcttcttcgtcgggaaagtcgctgctcatacggtgacattcatctactactgcttcgcgatccctgtgtctgttctgttccctgagatccagatccctctctggggagttgtctatgtcccgacagtcataaccctcttgaaggctcttggcacaccgagttcctttcacctggtgatcctctgggtcctgtttgagaatgtcatgtcgttgcaccggattaaggctgcagtaagtggtcttctggatgctggtgggcgagtcaatgagtgggttgtcactgagaagttgggcgacaccagcaaggcaaagcctggcaccaatggatcagacactgctgtaaaggtgatagatgtgaagctaacagaaccgcttgttccgaagctagtgaagaggcgagcaagattttgggagaggtaccactgctcagaacttttcgttggaacctgcataatcctgtgtggtttctatgacctgctttttgcaaataagggatactacatttttctcttccttcaaggcacggcgttccttgttgttggttttgggtatgtcggcacactacctccttgcactgcataagctgtcatggacaactgatattacctgctcaccagaaactgagcaagcaaagctcctctctcctgcacatatcaaactcttgaattcaatgatagttgagcaatgttcccccatcagtcttggcctgacatgatccaccgccgagaaggttgttcagatatcgccgtcgttctcctgtcagtgttggtcagatttgagccaaaccattctttattgtcagaaggccattcaaatagtgtcaccattgcaaattttataataacggtgtttaccgaagcatcatgaaaagaaaaatgattggtgcagcagcatttcgttcgcattccatagagatgcagttcacatccagtatttttttttggaaatctagtgttattactcagagttcagatccataatggaagattgttggcttcctcagttcataacctgtgtaggcttaaaacttgtagatgtaaattgttattaacactaatattttttattgaatccgggtattattgaaatgcaagtgtagcatgcatttcttttcctgtaagaagccaaagatgacttctgagtaacacgtctaatcagacattttacttgatg

SEQ ID NO: 16 - protein, 456 aa, Zea mays
PVVLVQIPMYNEREVYKLSIGAACALEWPPERFVIQVLDDSTDPVDLVETECQRWKSKGVNIKYEVRGNRKGYKAGALKEGLKHDYVADCEYIAMFDADFQPDSDFLLRTIPFLVHNPEIALVQARWKFVNSDECLLTRFQEMSLDYHFKYEQEAGSSVYSFFGFNGTAGVWRISAIDDAGGWKDRTTVEDMDLAVRAMLQGWKFLYVGDIKVKSELPSTFKAYRFQQHRWSCGPANLFKKMMVEILENKRVSLWSKIHLWYDFFFVGKVAAHTVTFIYYCFAIPVSVLFPEIQIPLWGVVYVPTVITLLKALGTPSSFHLVILWVLFENVMSLHRIKAAVSGLLDAGGRVNEWVVTEKLGDTSKAKPGTNGSDTAVKVIDVKLTEPLVPKLVKRRARFWERYHCSELFVGTCIILCGFYDLLFANKGYYIFLFLQGTAFLVVGFGYVGTLPPCTA

SEQ ID NO: 17 - DNA, 1937 bp, Zea mays
aatggcggtactggcggagctggggacggtgccggcggcgggctactcccgcagcgacgtcgcggcggcgctgtggcagcagctcaagtccccggtggtggtgccgctgctgcgggtgtcggtggcgctgtgcctggccatgtccgcgatgctgttcgcggagaaggtgtacatggccgtggtggtcgccgcgtcgcgcctgctcgggcggcggcccgagcggcggtaccggtggcagcccatccgcgacggcgacgacctcgaggcggccgccgcctaccccatggtgctcgtccagatccccatgttcaacgagcgggaggtgtacaaggtgtcgatcggggcggcgtgcgggctgtcgtggccgtcggaccggatcatcgtgcaggtgctggacgactccaccgaccccgtcgtcaaggagctggttcgtgctgagtgctggcggtgggcgagcaagggcgtgaacgtcaagtacgaggtccgcgacagccggcgagggtacaaggccggcgcgctccgggaaggcatgaagcgcgcctacgcccgcggctgcgacctggtggccatcttcgacgccgacttccagccggagccggacttcctgtggcgcgccgtgccgttccttctccacaacccggacctcgcgctcgtccaggcgcgctggaagttcgtgaacgcagacgaatgcctgatgacaaggatgcaggagatgtccctggactaccacttcgcagtggagcaggaagtcggctcctccacctacgccttcttcggcttcaacggaaccgctggcgtgtggcgcatatccgctttgaacgaggccggagggtggaaggacaggaccacggtggaggacatggatctggcagtccgagcaagcctcaaagggtggaagtttgtatacatcggtgacctcatggtgaaaagcgagctcccgagcacactcaaagcgtacaggtaccagcagcacagatggtcgtgtgggccggcaaacttgttcaggaaaacgctggtggagatcgtcagaaacaagaaggtgacgctctggaagaaaatccacgtcatctacaacttcttcctcgtgcgcaagatcgtagcgcacgccgtgacgttcgtgttttactgcatcgtgatccccacgacggtcctggttcctgaggttcaagtgccaaagtggggttccgtctatatcccaaccgtaataacccttctcagtgctgttgccactccaaggtcagctcacttagttgtcttctggaccctcttcgagaatgtgatgtcgctgcatagaaccaaggccactttcatcggcctactggaggcaggcagggtgaacgagtgggtggtgacagaaaaactcggtgatgctctcaggaccaaagtgccaggcaagaaaccccgcatgaggataggagacaggttgcacgttctggagctcggtgtcgcagcttacctcctcttctgtggatgctatgacattgcgttcgggaacaaccgctactacatattcttgttcctccaatccatcgctttcttcatcgtcggcattggctatgtcggaacattcgtccctcactagctagctcgtagcagaatcattctgagaggctacccatcctgatgatgcatggttgtcttcaaccccttccggtttcatttcatggaaatcagttggtagataagatcgagcaaaccttctcttgtatgtaatgttgtcatgggaaaaaaaagaaaatacagtgtaaaggcacactggcagacaagccatagatatgagtaggtatgtgtgttgttgaaggaatgtgctgtgatgcgcatggggggattggtgatgacaagcaggccgttttgagtctccatgtcacctatgcagaatcagctgtagaaaaaaaggtagcaaattgtggaagtcgaaccaattgttttgcaaacat

SEQ ID NO: 18 - protein, 526 aa, Zea mays
MAVLAELGTVPAAGYSRSDVAAALWQQLKSPVVVPLLRVSVALCLAMSAMLFAEKVYMAVVVAASRLLGRRPERRYRWQPIRDGDDLEAAAAYPMVLVQIPMFNEREVYKVSIGAACGLSWPSDRIIVQVLDDSTDPVVKELVRAECWRWASKGVNVKYEVRDSRRGYKAGALREGMKRAYARGCDLVAIFDADFQPEPDFLWRAVPFLLHNPDLALVQARWKFVNADECLMTRMQEMSLDYHFAVEQEVGSSTYAFFGFNGTAGVWRISALNEAGGWKDRTTVEDMDLAVRASLKGWKFVYIGDLMVKSELPSTLKAYRYQQHRWSCGPANLFRKTLVEIVRNKKVTLWKKIHVIYNFFLVRKIVAHAVTFVFYCIVIPTTVLVPEVQVPKWGSVYIPTVITLLSAVATPRSAHLVVFWTLFENVMSLHRTKATFIGLLEAGRVNEWVVTEKLGDALRTKVPGKKPRMRIGDRLHVLELGVAAYLLFCGCYDIAFGNNRYYIFLFLQSIAFFIVGIGYVGTFVPH

SEQ ID NO: 19 - DNA, 581 bp, Arabidopsis thaliana
atgcaagaaatgtcattggattaccatttcactgttgagcaagaagtgggttcatcaacacatgcttttttcggcttcaacggaaccgccggaatatggagaatagcggcgataaatgaagctggtgggtggaaagatcggaccaccgtggaagatatggatctcgccgtccgagcaagtcttcgcggctggaaatttctctacctcggtgaccttcaggtgaaaagtgagcttccaagtacttttagagccttccgttttcagcaacatagatggtcttgtggacctgcaaatctctttaggaaaatggttatggagatcgtaagaaacaagaaagtgagattctggaagaaagtgtacgtgatatacagcttcttctttgtgaggaaaatcattgcacattgggtcacattttgtttctactgcgttgttcttcctctcacaattctcgtcccggaggttaaagttccgatttggggttcggtttatatcccatccatcatcactatcctcaattccgtcggtactccaaggtcaattcatctgctgttctattggattctattcgagaatgtgatgtc

SEQ ID NO: 20 - DNA, 581 bp, Arabidopsis thaliana
atgcaagaaatgtctttggattatcattttacggtggaacaagaagttggttcttctacttacgctttcttcggattcaatggaactgcgggaatatggagaatatcggcattaaacgaagctggtggttggaaagatagaacgaccgtggaagatatggatttggccgtgagagctagtctcaagggttggaaattcttgtacctcggttctttgaaggttaaaaacgagttgccaagtacattcaaggcttataggtatcaacagcacaggtggtcatgtggtccagctaatcttttcaggaaaatggcattcgaaatcatgactaataagaacgtgactttgtggaagaaagttcatgtgatatatagcttcttcgtggttagaaagctagtggcacacattgttaccttcatcttctactgtgtgatcttacccgctacagttcttgtaccggaagttactgttccgaaatggggagcgttttacattccttcagtcattactctcctcaacgccgttgggacaccaaggtcattgcatcttatggtcttttggattctgttcgagaatgtgatgtc

SEQ ID NO: 21 - DNA, 439 bp, Arabidopsis thaliana
atgcaagaaatgtcttggattacatttacgtgacaagaagtggttctcacagctttttcggttcaaggaacgcggaatatggagaatacggctaaagaagctggtggtggaaagatgacaccgtggaagatatggattgccgtgagcagtctggtggaaattttacctcggttaggtaaaagagtccaagtacttagctgttcacacaagtggtctgtggccgcaatctttaggaaaatggtgaatctaaaaagaagtgatttggaagaaagtagtgatataagcttcttctgtagaattgcacagtacttttctactggtgtcttcccacattctgtccggagttagttccgatggggcgtttaatcctctcatacttcctcaaccgtggacccaaggtcatcatcttgtctttggattctttcgagaatgtgatgtc

SEQ ID NO: 22 - protein, 1081 aa, Arabidopsis thaliana
MEASAGLVAGSYRRNELVRIRHESDGGTKPLKNMNGQICQICGDDVGLAETGDVFVACNECAFPVCRPCYEYERKDGTQCCPQCKTRFRRHRGSPRVEGDEDEDDVDDIENEFNYAQGANKARHQRHGEEFSSSSRHESQPIPLLTHGHTVSGEIRTPDTQSVRTTSGPLGPSDRNAISSPYIDPRQPVPVRIVDPSKDLNSYGLGNVDWKERVEGWKLKQEKNMLQMTGKYHEGKGGEIEGTGSNGEELQMADDTRLPMSRVVPIPSSRLTPYRVVIILRLIILCFFLQYRTTHPVKNAYPLWLTSVICEIWFAFSWLLDQFPKWYPINRETYLDRLAIRYDRDGEPSQLVPVDVFVSTVDPLKEPPLVTANTVLSILSVDYPVDKVACYVSDDGSAMLTFESLSETAEFAKKWVPFCKKFNIEPRAPEFYFAQKIDYLKDKIQPSFVKERRAMKREYEEFKVRINALVAKAQKIPEEGWTMQDGTPWPGNNTRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNIVFFDINMKGLDGIQGPVYVGTGCCFNRQALYGYDPVLTEEDLEPNIIVKSCCGSRKKGKSSKKYNYEKRRGINRSDSNAPLFNMEDIDEGFEGYDDERSILMSQRSVEKRFGQSPVFIAATFMEQGGIPPTTNPATLLKEAIHVISCGYEDKTEWGKEIGWIYGSVTEDILTGFKMHARGWISIYCNPPRPAFKGSAPINLSDRLNQVLRWALGSIEILLSRHCPIWYGYHGRLRLLERIAYINTIVYPITSIPLIAYCILPAFCLITDRFIIPEISNYASIWFILLFISIAVTGILELRWSGVSIEDWWRNEQFWVIGGTSAHLFAVFQGLLKVLAGIDTNFTVTSKATDEDGDFAELYIFKWTALLIPPTTVLLVNLIGIVAGVSYAVNSGYQSWGPLFGKLFFALWVIAHLYPFLKGLLGRQNRTPTIVIVWSVLLASIFSLLWVRINPFVDANPNANNFNGKGGVF

SEQ ID NO: 23 - protein, 1065 aa, Arabidopsis thaliana
MVAGSYRRYEFVRNRDDSDDGLKPLKDLNGQICQICGDDVGLTKTGNVFVACNECGFPLCQSCYEYERKDGSQCCPQCKARFRRHNGSPRVEVDEKEDDVNDIENEFDYTQGNNKARLPHRAEEFSSSSRHEESLPVSLLTHGHPVSGEIPTPDRNATLSPCIDPQLPGIYQLLLLPVRILDPSKDLNSYGLVNVDWKKRIQGWKLKQDKNMIHMTGKYHEGKGGEFEGTGSNGDELQMVDDARLPMSRVVHFPSARMTPYRIVIVLRLIILGVFLHYRTTHPVKDAYALWLTSVICEIWFAFSWLLDQFPKWYPINRETFLDRLALRYDRDGEPSQLAPVDVFVSTVDPMKEPPLVTANTVLSILAVDYPVDKVACYVSDDGSAMLTFEALSETAEFSKKWVPFCKKFNIEPRAPEFYFSQKIDYLKDKIQPSFVKERRAMKREYEEFKVRINILVAKAQKIPEDGWTMEDGTSWPGNNPRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNTVFFDINLKGLDGIQGPVYVGTGCCFNRQALYGYDPVLTEEDLEPNIIVKSCFGSRKKGKSRKIPNYEDNRSIKRSDSNVPLFNMEDIDEDVEGYEDEMSLLVSQKRLEKRFGQSPVFIAATFMEQGGLPSTTNPLTLLKEAIHVISCGYEAKTDWGKEIGWIYGSVTEDILTGFKMHARGWISIYCVPSRPAFKGSAPINLSDRLNQVLRWALGSIEILLSRHCPIWYGYNGRLKLLERIAYINTIVYPITSIPLLAYCMLPAFCLITNTFIIPEISNLASLCFMLLFASIYASAILELKWSDVALEDWWRNEQFWVIGGTSAHLFAVFQGLLKVFAGIDTNFTVTSKASDEDGDFAELYVFKWTSLLIPPTTILLVNLVGIVAGVSYAINSGYQSWGPLMGKLLFAFWVVAHLYPFLKGLLGRQNRTPTIVIVWSALLASIFSLLWVRINPFVSTTGVMSNSFMGE

SEQ ID NO: 24 - protein, 1084 aa, Arabidopsis thaliana
MNTGGRLIAGSHNRNEFVLINADESARIRSVQELSGQTCQICGDEIELTVSSELFVACNECAFPVCRPCYEYERREGNQACPQCKTRYKRIKGSPRVDGDDEEEEDIDDLEYEFDHGMDPEHAAEAALSSRLNTGRGGLDSAPPGSQIPLLTYCDEDADMYSDRHALIVPPSTGYGNRVYPAPFTDSSAPPQARSMVPQKDIAEYGYGSVAWKDRMEVWKRRQGEKLQVIKHEGGNNGRGSNDDDELDDPDMPMMDEGRQPLSRKLPIRSSRINPYRMLILCRLAILGLFFHYRILHPVNDAYGLWLTSVICEIWFAVSWILDQFPKWYPIERETYLDRLSLRYEKEGKPSGLAPVDVFVSTVDPLKEPPLITANTVLSILAVDYPVDKVACYVSDDGAAMLTFEALSDTAEFARKWVPFCKKFNIEPRAPEWYFSQKMDYLKNKVHPAFVRERRAMKRDYEEFKVKINALVATAQKVPEEGWTMQDGTPWPGNNVRDHPGMIQVFLGHSGVRDTDGNELPRLVYVSREKRPGFDHHKKAGAMNSLIRVSAVLSNAPYLLNVDCDHYINNSKAIRESMCFMMDPQSGKKVCYVQFPQRFDGIDRHDRYSNRNVVFFDINMKGLDGIQGPIYVGTGCVFRRQALYGFDAPKKKKPPGKTCNCWPKWCCLCCGLRKKSKTKAKDKKTNTKETSKQIHALENVDEGVIVPVSNVEKRSEATQLKLEKKFGQSPVFVASAVLQNGGVPRNASPACLLREAIQVISCGYEDKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLIVYCSLPAVCLLTGKFIVPEISNYAGILFMLMFISIAVTGILEMQWGGVGIDDWWRNEQFWVIGGASSHLFALFQGLLKVLAGVNTNFTVTSKAADDGAFSELYIFKWTTLLIPPTTLLIINIIGVIVGVSDAISNGYDSWGPLFGRLFFALWVIVHLYPFLKGMLGKQDKMPTIIVVWSILLASILTLLWVRVNPFVAKGGPVLEICGLNCGN

SEQ ID NO: 25 - protein, 1065 aa, Arabidopsis thaliana
MESEGETAGKPMKNIVPQTCQICSDNVGKTVDGDRFVACDICSFPVCRPCYEYERKDGNQSCPQCKTRYKRLKGSPAIPGDKDEDGLADEGTVEFNYPQKEKISERMLGWHLTRGKGEEMGEPQYDKEVSHNHLPRLTSRQDTSGEFSAASPERLSVSSTIAGGKRLPYSSDVNQSPNRRIVDPVGLGNVAWKERVDGWKMKQEKNTGPVSTQAASERGGVDIDASTDILADEALLNDEARQPLSRKVSIPSSRINPYRMVIMLRLVILCLFLHYRITNPVPNAFALWLVSVICEIWFALSWILDQFPKWFPVNRETYLDRLALRYDREGEPSQLAAVDIFVSTVDPLKEPPLVTANTVLSILAVDYPVDKVSCYVFDDGAAMLSFESLAETSEFARKWVPFCKKYSIEPRAPEWYFAAKIDYLKDKVQTSFVKDRRAMKREYEEFKIRINALVSKALKCPEEGWVMQDGTPWPGNNTGDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKAKKESDKKKSGRHTDSTVPVFNLDDIEEGVEGAGFDDEKALLMSQMSLEKRFGQSAVFVASTLMENGGVPPSATPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYNGRLKFLERFAYVNTTIYPITSIPLLMYCTLLAVCLFTNQFIIPQISNIASIWFLSLFLSIFATGILEMRWSGVGIDEWWRNEQFWVIGGVSAHLFAVFQGILKVLAGIDTNFTVTSKASDEDGDFAELYLFKWTTLLIPPTTLLIVNLVGVVAGVSYAINSGYQSWGPLFGKLFFAFWVIVHLYPFLKGLMGRQNRTPTIVVVWSVLLASIFSLLWVRIDPFTSRVTGPDILECGINC

SEQ ID NO: 26 - protein, 1016 aa, Arabidopsis thaliana
MQHRHSSFSAKICKVCGDEVKDDDNGQTFVACHVCVYPVCKPCYEYERSNGNKCCPQCNTLYKRHKVSLSHLDQILSIFSVMQENGDYNSKQQWRPNGRAFSSTGSVLGKDFEAERDGYTDAEWKERVDKWKARQEKRGLVTKGEQTNEDKEDDEEEYLDAEARQPLWRKVPISSSKISPYRIVIVLRLVILVFFFRFRILTPAKDAYPLWLISVICEIWFALSWILDQFPKWFPINRETYLDRLSMRFERDGEKNKLAPVDVFVSTVDPLKEPPIITANTILSILAVDYPVNKVSCYVSDDGASMLLFDTLSETSEFARRWVPFCKKYNVEPRAPEFYFSEKIDYLKDKVQTTFVKDRRAMKREYEEFKVRINALVAKAQKKPEEGWVMQDGTPWPGNNTRDHPGMIQVYLGKEGAFDIDGNELPRLVYVSREKRPGYAHHKKAGAMNAMVRVSAVLTNAPFMLNLDCDHYINNSKAIRESMCFLMDPQLGKKLCYVQFPQRFDGIDLNDRYANRNIVFFDINMRGLDGIQGPVYVGTGCVFNRPALYGYEPPVSEKRKKMTCDCWPSWICCCCGGGNRNHKSDSSKKKSGIKSLFSKLKKKTKKKSDDKTMSSYSRKRSSTEAIFDLEDIEEGLEGYDELEKSSLMSQKNFEKRFGMSPVFIASTLMENGGLPEATNTSSLIKEAIHVISCGYEEKTEWGKEIGWIYGSVTEDILTGFRMHCRGWKSVYCMPKRPAFKGSAPINLSDRLHQVLRWALGSVEIFFSRHCPLWYAWGGKLKILERLAYINTIVYPFTSIPLLAYCTIPAVCLLTGKFIIPTINNFASIWFLALFLSIIATAILELRWSGVSINDLWRNEQFWVIGGVSAHLFAVFQGLLKVLFGVDTNFTVTSKGASDEADEFGDLYLFKWTTLLIPPTTLIILNMVGVVAGVSDAINNGYGSWGPLFGKLFFAFWVIVHLYPFLKGLMGRQNRTPTIVVLWSILLASIFSLVWVRIDPFLPKQTGPLLKQCGVDC

SEQ ID NO: 27 - protein, 1069 aa, Arabidopsis thaliana
MNTGGRLIAGSHNRNEFVLINADESARIRSVEELSGQTCQICGDEIELSVDGESFVACNECAFPVCRPCYEYERREGNQSCPQCKTRYKRIKGSPRVEGDEEDDGIDDLDFEFDYSRSGLESETFSRRNSEFDLASAPPGSQIPLLTYGEEDVEISSDSHALIVSPSPGHIHRVHQPHFPDPAAHPRPMVPQKDLAVYGYGSVAWKDRMEEWKRKQNEKYQVVKHDGDSSLGDGDDADIPMMDEGRQPLSRKVPIKSSKINPYRMLIVLRLVILGLFFHYRILHPVNDAYALWLISVICEIWFAVSWVLDQFPKWYPIERETYLDRLSLRYEKEGKPSELAGVDVFVSTVDPMKEPPLITANTVLSILAVDYPVDRVACYVSDDGAAMLTFEALSETAEFARKWVPFCKKYTIEPRAPEWYFCHKMDYLKNKVHPAFVRERRAMKRDYEEFKVKINALVATAQKVPEEGWTMQDGTPWPGNNVRDHPGMIQVFLGNNGVRDVENNELPRLVYVSREKRPGFDHHKKAGAMNSLIRVSGVLSNAPYLLNVDCDHYINNSKALREAMCFMMDPQSGKKICYVQFPQRFDGIDKSDRYSNRNVVFFDINMKGLDGLQGPIYVGTGCVFRRQALYGFDAPKKKKTKRMTCNCWPKWCLFCCGLRKNRKSKTTDKKKKNREASKQIHALENIEEGTKGTNDAAKSPEAAQLKLEKKFGQSPVFVASAGMENGGLARNASPASLLREAIQVISCGYEDKTEWGKEIGWIYGSVTEDILTGFKMHSHGWRSVYCTPKIPAFKGSAPINLSDRLHQVLRWALGSVEIFLSRHCPIWYGYGGGLKWLERLSYINSVVYPWTSIPLLVYCSLPAICLLTGKFIVPEISNYASILFMALFGSIAVTGILEMQWGKVGIDDWWRNEQFWVIGGVSAHLFALFQGLLKVLAGVETNFTVTSKAADDGEFSELYIFKWTSLLIPPTTLLIINVIGVIVGISDAISNGYDSWGPLFGRLFFAFWVILHLYPFLKGLLGKQDRMPTIILVWSILLASILTLLWVRVNPFVAKGGPILEICGLDCL

SEQ ID NO: 28 - protein, 1084 aa, Arabidopsis thaliana
MNTGGRLIAGSHNRNEFVLINADENARIRSVQELSGQTCQICRDEIELTVDGEPFVACNECAFPVCRPCYEYERREGNQACPQCKTRFKRLKGSPRVEGDEEEDDIDDLDNEFEYGNNGIGFDQVSEGMSISRRNSGFPQSDLDSAPPGSQIPLLTYGDEDVEISSDRHALIVPPSLGGHGNRVHPVSLSDPTVAAHPRPMVPQKDLAVYGYGSVAWKDRMEEWKRKQNEKLQVVRHEGDPDFEDGDDADFPMMDEGRQPLSRKIPIKSSKINPYRMLIVLRLVILGLFFHYRILHPVKDAYALWLISVICEIWFAVSWVLDQFPKWYPIERETYLDRLSLRYEKEGKPSGLSPVDVFVSTVDPLKEPPLITANTVLSILAVDYPVDKVACYVSDDGAAMLTFEALSETAEFARKWVPFCKKYCIEPRAPEWYFCHKMDYLKNKVHPAFVRERRAMKRDYEEFKVKINALVATAQKVPEDGWTMQDGTPWPGNSVRDHPGMIQVFLGSDGVRDVENNELPRLVYVSREKRPGFDHHKKAGAMNSLIRVSGVLSNAPYLLNVDCDHYINNSKALREAMCFMMDPQSGKKICYVQFPQRFDGIDRHDRYSNRNVVFFDINMKGLDGLQGPIYVGTGCVFRRQALYGFDAPKKKKGPRKTCNCWPKWCLLCFGSRKNRKAKTVAADKKKKNREASKQIHALENIEEGRVTKGSNVEQSTEAMQMKLEKKFGQSPVFVASARMENGGMARNASPACLLKEAIQVISCGYEDKTEWGKEIGWIYGSVTEDILTGFKMHSHGWRSVYCTPKLAAFKGSAPINLSDRLHQVLRWALGSVEIFLSRHCPIWYGYGGGLKWLERLSYINSVVYPWTSLPLIVYCSLPAICLLTGKFIVPEISNYASILFMALFSSIAITGILEMQWGKVGIDDWWRNEQFWVIGGVSAHLFALFQGLLKVLAGVDTNFTVTSKAADDGEFSDLYLFKWTSLLIPPMTLLIINVIGVIVGVSDAISNGYDSWGPLFGRLFFALWVIIHLYPFLKGLLGKQDRMPTIIVVWSILLASILTLLWVRVNPFVAKGGPILEICGLDCL

SEQ ID NO: 29 - protein, 1026 aa, Arabidopsis thaliana
MEASAGLVAGSHNRNELVVIHNHEEPKPLKNLDGQFCEICGDQIGLTVEGDLFVACNECGFPACRPCYEYERREGTQNCPQCKTRYKRLRGSPRVEGDEDEEDIDDIEYEFNIEHEQDKHKHSAEAMLYGKMSYGRGPEDDENGRFPPVIAGGHSGEFPVGGGYGNGEHGLHKRVHPYPSSEAGSEGGWRERMDDWKLQHGNLGPEPDDDPEMGLIDEARQPLSRKVPIASSKINPYRMVIVARLVILAVFLRYRLLNPVHDALGLWLTSVICEIWFAVSWILDQFPKWFPIERETYLDRLSLRYEREGEPNMLAPVDVFVSTVDPLKEPPLVTSNTVLSILAMDYPVEKISCYVSDDGASMLTFESLSETAEFARKWVPFCKKFSIEPRAPEMYFTLKVDYLQDKVHPTFVKERRAMKREYEEFKVRINAQVAKASKVPLEGWIMQDGTPWPGNNTKDHPGMIQVFLGHSGGFDVEGHELPRLVYVSREKRPGFQHHKKAGAMNALVRVAGVLTNAPFMLNLDCDHYVNNSKAVREAMCFLMDPQIGKKVCYVQFPQRFDGIDTNDRYANRNTVFFDINMKGLDGIQGPVYVGTGCVFKRQALYGYEPPKGPKRPKMISCGCCPCFGRRRKNKKFSKNDMNGDVAALGGAEGDKEHLMFEMNFEKTFGQSSIFVTSTLMEEGGVPPSSSPAVLLKEAIHVISCGYEDKTEWGTELGWIYGSITEDILTGFKMHCRGWRSIYCMPKRPAFKGSAPINLSDRLNQVLRWALGSVEIFFSRHSPLWYGYKGGKLKWLERFAYANTTIYPFTSIPLLAYCILPAICLLTDKFIMPPISTFASLFFISLFMSIIVTGILELRWSGVSIEEWWRNEQFWVIGGISAHLFAVVQGLLKILAGIDTNFTVTSKATDDDDFGELYAFKWTTLLIPPTTVLIINIVGVVAGISDAINNGYQSWGPLFGKLFFSFWVIVHLYPFLKGLMGRQNRTPTIVVIWSVLLASIFSLLWVRIDPFVLKTKGPDTSKCGINC

SEQ ID NO: 30 - protein, 985 aa, Arabidopsis thaliana
MMESRSPICNTCGEEIGAKSNGEFFVACHECSFPICKACLEYEFKEGRRICLRCGNPYDENVFDDVETKTSKTQSIVPTQTNNTSQDSGIHARHISTVSTIDSELNDEYGNPIWKNRVESWKDKKDKKSKKKKKDPKATKAEQQDAQVPTQQHMEDMPPNTESGATDVLSVVIPIPRTKITSYRIVIIMRLIILALFFNYRITHPVDSAYGLWLTSVICEIWFAVSWVLDQFPKWSPINRETYIDRLSARFEREGEQSQLAAVDFFVSTVDPLKEPPLITANTVLSILALDYPVDKVSCYVSDDGAAMLSFESLVETADFARKWVPFCKKYSIEPRAPEFYFSLKIDYLRDKVQPSFVKERRAMKRDYEEFKIRMNALVAKAQKTPEEGWTMQDGTSWPGNNTRDHPGMIQVFLGYSGARDIEGNELPRLVYVSREKRPGYQHHKKAGAENALVRVSAVLTNAPFILNLDCDHYVNNSKAVREAMCFLMDPVVGQDVCFVQFPQRFDGIDKSDRYANRNIVFFDVNMRGLDGIQGPVYVGTGTVFRRQALYGYSPPSKPRILPQSSSSSCCCLTKKKQPQDPAEIYKDAKREELDAAIFNLGDLDNYDEYDRSMLISQTSFEKTFGLSTVFIESTLMENGGVPDSVNPSTLIKEAIHVISCGYEEKTEWGKEIGWIYGSITEDILTGFKMHCRGWRSIYCMPLRPAFKGSAPINLSDRLHQVLRWALGSVEIFLSRHCPLWYGCSGGRLKLLQRLAYINTIVYPFTSLPLVAYCTLPAICLLTGKFIIPTLSNLASMLFLGLFISIILTSVLELRWSGVSIEDLWRNEQFWVIGGVSAHLFAVFQGFLKMLAGLDTNFTVTSKTADDLEFGELYIVKWTTLLIPPTSLLIINLVGVVAGFSDALNKGYEAWGPLFGKVFFAFWVILHLYPFLKGLMGRQNRTPTIVILWSILLASVFSLVWVRINPFVSKTDTTSLSLNCLLIDC

SEQ ID NO: 31 - protein, 1088 aa, Arabidopsis thaliana
MNTGGRLIAGSHNRNEFVLINADDTARIRSAEELSGQTCKICRDEIELTDNGEPFIACNECAFPTCRPCYEYERREGNQACPQCGTRYKRIKGSPRVEGDEEDDDIDDLEHEFYGMDPEHVTEAALYYMRLNTGRGTDEVSHLYSASPGSEVPLLTYCDEDSDMYSDRHALIVPPSTGLGNRVHHVPFTDSFASIHTRPMVPQKDLTVYGYGSVAWKDRMEVWKKQQIEKLQVVKNERVNDGDGDGFIVDELDDPGLPMMDEGRQPLSRKLPIRSSRINPYRMLIFCRLAILGLFFHYRILHPVNDAFGLWLTSVICEIWFAVSWILDQFPKWYPIERETYLDRLSLRYEKEGKPSELAPVDVFVSTVDPLKEPPLITANTVLSILAVDYPVEKVACYVSDDGAAMLTFEALSYTAEFARKWVPFCKKFSIEPRAPEWYFSQKMDYLKHKVDPAFVMERRAMKRDYEEFKVKINALVSVSQKVPEDGWTMQDGTPWPGNNVRDHPGMIQVFLGHSGVCDMDGNELPRLVYVSREKRPGFDHHKKAGAMNSLIRVSAVLSNAPYLLNVDCDHYINNSKAIREAMCFMMDPQSGKKICYVQFPQRFDGIDRHDRYSNRNVVFFDINMKGLDGIQGPIYVGTGCVFRRQALYGFDAPKKKQPPGRTCNCWPKWCCLCCGMRKKKTGKVKDNQRKKPKETSKQIHALEHIEEGLQVTNAENNSETAQLKLEKKFGQSPVLVASTLLLNGGVPSNVNPASLLRESIQVISCGYEEKTEWGKEIGWIYGSVTEDILTGFKMHCHGWRSVYCMPKRAAFKGSAPINLSDRLHQVLRWALGSVEIFLSRHCPIWYGYGGGLKWLERFSYINSVVYPWTSLPLLVYCSLPAICLLTGKFIVPEISNYAGILFLLMFMSIAVTGILEMQWGKIGIDDWWRNEQFWVIGGVSSHLFALFQGLLKVLAGVSTNFTVTSKAADDGEFSELYIFKWTSLLIPPTTLLIINIVGVIVGVSDAINNGYDSWGPLFGRLFFALWVIVHLYPFLKGLLGKQDRVPTIILVWSILLASILTLLWVRVNPFVSKDGPVLEICGLDCLK

SEQ ID NO: 32 - protein, 401 aa, Arabidopsis thaliana
MVDLVVQVVDDFTDPAVREGVDVEIAKWQSQGINIRCERRDNRNGYKAGAMKEALTQSYVKQCDFVAVFDADFQPEPDYLIRAVPFLVHNPDVALVQARWIFVNANKCLMTRMQEMSLNYHFKVEQESGSTRHAFFGFNGTAGVWRISAMEAAGGWKSRTTVEDMDLAVRVGLHGWKFVYLNDLTVRNELPSKFKAYRFQQHRWSCGPANLFRKMTMEIIFNKRVSIWKKFYVIYSFFFVRKVAVHFLTFFFYCIIVPTSVFFPEIHIPSWSTIYVPSLISIFHTLATPRSFYLVIFWVLFENVMAMHRTKGTCIGLLEGGRVNEWVVTEKLGDALKSKLLSRVVQRKSCYQRVNSKEVMVGVYILGCALYGLIYGHTWLHFYLFLQATAFFVSGFGFVGT

SEQ ID NO: 33 - protein, 552 aa, Arabidopsis thaliana
MTTFLKSLIFLQDSCLAFLSLMFHRGSSEDAAEALKKLETSINGARISFDTTWTREFRSLFIVPLFKCLVAFCLIISLLVFIEGIYMNLVVLYVKVFERKPEKVYRWEAMQEDIELGHETYPMVLVQIPMYNEKEVLQLSIGAACRLIWPLDRLIVQVLDDSTDQTIKELVNTECAKWESKGVNIKCERRDNRNGYKAGALKEGMKHNYVKLCNYVVIFDADFQPEPDYLQHSVPFLVHNPEVALVQARWRFMNANKCLMTRMQEMSLNYHFMAEQESGSTRHAFFSFNGTAGVWRMAAMEEAGGWHDRTTVEDMDLAVRAGLLGWKFVFLNDLTVKSELPSKFKAFRFQQHRWSCGPANLFRKMIMEIIRNKRVTIWKKLYLVYSFFFLRKIIVHCFTFIFYCVILPTSVFFPEVNIPAWSTFYIPSMITLCIVIATPRSFYLVIFWILFENVMSMHRTKGTFIGILERQRVNEWVVTEKLGDALKTKLLPRIGKPSNMFLERVNSKEIMVGIYILCCACYGLFFGNTLLYLYLFMQAVAFLISGVGFVGT

SEQ ID NO: 34 - protein, 443 aa, Arabidopsis thaliana
MQEDLELGNQNFPMVLVQIPMYNEREVFKLSIGAACRLIWPLDRLIVQVLDDSTDPTIMEMVSTECGKWATKGINIKCERRDNRNGYKAGALKQGMRHSYVKTCTYIAIFDADFQPEPDYLERTVPFLIHNPELALVQARWKFVNAKKCLMTRMQEMSLNYHFTAEQESGSTRHAFFGFNGTAGVWRLAAMEEAGGWKDRTTVEDMDLAVRVGLHGWKFVFVNDVSVKSELPSQFKAFRFQQHRWSCGPANLFRKMTMEIIRNKRVTIWKKLYVIYSFFFVRKIIVHFFTFFFYCFILPTSVFFPEVNIPTWSTVYFPFMITLFNAIATPRSFYLVIFWVLFENVMAMHRTKGTFIGLLEGGRVNEWVVTEKLGDALETKLLPQVRKPRNGFLERINSKEMMVGIYILCCASYNLVFGKTVLYIYLYMQALAFIIAGIGFIGT

SEQ ID NO: 35 - protein, 535 aa, Arabidopsis thaliana
MATLSDGLFDDMSVLGVIGYVLEQTRFIFLVPILKRLVNLCQVVSVLLFVDAAYMAIVVAIVKLLGRTPQKVLKWESFKSDDIELAPSSNHPMVLIQIPIFNEKEVCQLSIGAACKLSWPLDRMIIQVLDDSTEEESQKLVRLECKKWESEGITIKSEVRGGFREGFKAGALTAGMKHSYVDEYKCEFVVIFDADFQPEPDFLERTVPFLVHNPEIALVQAGWKYGNADECCMTRIQEMSLNYHFAVEQKSGSSILGFFGFNGTAGVWRIKALNEAEGWKDRTIVEDMDLAVRAYLRGSKFVYVDDVKVKNELPSSFQAYRFQQHRWSCGPANLFKKIAMEIIKNQNVSLWKKVYLIYNFFFLRKIVVHIFTFVFYCVILPATVIFPEIEVPKWTTIYIPATITILNAIATPKSFYLILYWILFENVMAMHRSIGTLIGLLETSRVKEWIVTQKLGESNNLRENLIFPDHYSFPERLRWREIMVGMYLFICGYYDFVFGRTYLYVYLFLQSIAFFVVGVGYVGMPVPSTPVQTSE

SEQ ID NO: 36 - protein, 537 aa, Arabidopsis thaliana
MFLLLKPLLSLHDLSLNLLSVMFHGETLKASVDGVGINMSTMWRETRNVFIVPLFKCIVVMCLIISLLVFVESVYMNLVVLYVKLFNRKPEKVYKWEAMQEDMELGHQNYPMVLVQIPMYNEREVFELSIGAACRLTWPSDRLIVQVLDDSTDPAIMELVSMECTKWASKDININYERRENRNGYKAGALKHGMRHSYVKQCQYLAIFDADFQPEPDYLQRAIPFLIHNPEVALVQARWRFVNANTCLMTRMQEMSLNYHFMAEQQSGSTRHAFFGFNGTAGVWRMVAMEEAGGWKDRTTVEDMDLAVRVGLLGWKFIFVNDLEVKSELPSQFKAFRFQQHRWSCGPANLIRKMTMEIIHNKRVKIWKKFYVIYSFFFLRKIVVHFFTYFFYCVILPTSVFLPEVNIPNWSTIYVPSVITLLSAIATPRSFYLVIFWVLFENVMAMHRTKGTLIGLFEGGRVNEWVVTEKLGDTLNTKLLPQNGRLPKRVNLKEMMMGIYILCCACYDFAFGNAFLYLYLFMQATAFLISGVGFVGT

SEQ ID NO: 37 - protein, 534 aa, Arabidopsis thaliana
MDGVSPKFVLPETFDGVRMEITGQLGMIWELVKAPVIVPLLQLAVYICLLMSVMLLCERVYMGIVIVLVKLFWKKPDKRYKFEPIHDDEELGSSNFPVVLVQIPMFNEREVYKLSIGAACGLSWPSDRLVIQVLDDSTDPTVKQMVEVECQRWASKGINIRYQIRENRVGYKAGALKEGLKRSYVKHCEYVVIFDADFQPEPDFLRRSIPFLMHNPNIALVQARWRFVNSDECLLTRMQEMSLDYHFTVEQEVGSSTHAFFGFNGTAGIWRIAAINEAGGWKDRTTVEDMDLAVRASLRGWKFLYLGDLQVKSELPSTFRAFRFQQHRWSCGPANLFRKMVMEIVRNKKVRFWKKVYVIYSFFFVRKIIAHWVTFCFYCVVLPLTILVPEVKVPIWGSVYIPSIITILNSVGTPRSIHLLFYWILFENVMSLHRTKATLIGLFEAGRANEWVVTAKLGSGQSAKGNTKGIKRFPRIFKLPDRLNTLELGFAAFLFVCGCYDFVHGKNNYFIYLFLQTMSFFISGLGWIGTYVPS

SEQ ID NO: 38 - protein, 556 aa, Arabidopsis thaliana
MSPFLKFFLFLYDYLSPSSFFLVQRNTLGASLDTTDGVVRSGIIGEIIYIWKQTRIFVFIPILKCLVTICLVMSLLLFIERVYMSIVVVFVKLLRRTPEKVHKWEPINDDDLELANTNYPMVLIQIPMYNEKEVCQLSIGAACRLSWPLDRMIVQVLDDSTDPASKELVNAECDKWARKGINIMSEIRDNRIGYKAGALKAGMMHNYVKQCEFVAIFDADFQPDPDFLERTIPFLIHNHEISLVQCRWKFVNANECLMTRMQEMSLNYHFVAEQESGSSIHAFFGFNGTAGVWRIAALNEAGGWKDRTTVEDMDLAVRACLHGWKFVYVHDVEVKNELPSTFKAYRFQQHRWSCGPANLWRKMTMEILQNKKVSAWKKLYLIYNFFFIRKIVVHIFTFVFYCLILPTTVLFPELQVPKWATVYFPTTITILNAIATPRSLHLLVFWILFENVMSMHRTKATFIGLLEAGRVNEWVVTEKLGDTLKSKLIGKATTKLYTRFGQRLNWRELVVGLYIFFCGCYDFAYGGSYFYVYLFLQSCAFFVAGVGYIGTFVPTV

SEQ ID NO: 39 - protein, 556 aa, Arabidopsis thaliana
MSPLPIFHRLPHATFSSFLLSLSQAGSSKTSVAFLNAFKSEDIIARIGLWWQLIRAVVVVPVFKFLVLLCLVMSVMFFVEVMYMGIVVLYVKLFKRKPEKFYKWEAMEDDVECGSASYPMVLVQIPMYNEKEVCEQSIAAACKISWPSNRIIIQVLDDSTDPASKELVKKECDRWSKEGVNITFEIRDNRNGYKAGALREGMRHSYVKQCDYVAIFDADFQPDPDFLHRTVPFLIHNPKLALVQGRWEFVNAGQCMMTRLQEMSLSYHFTIEQQVGSSTFAFFGFNGTAGVWRISALNESGGWNDQTTVEDMDLAVRATLRGWKFLYIDDLKVKSELPCSFKALRSQQHRWTCGPANLLRKMAGQIIRSENVSLWKKWYMLYSFFFMRKIVAHILTFCFYCVILPATVLFPEVTVPKWAAFYLPSLITLLIAIGRLRSIHLLAFWVLFENAMSLLRAKALVMGLFETGRVQEWVVTEKLGDTLKTKLIPQVPNVRFRERVHLLELLVGAYLLFCGIYDIVYGKNTLYVYLLFQSVAFFVVGFGFVGKYVPASSYLA

SEQ ID NO: 40 - protein, 533 aa, Arabidopsis thaliana
MELGDTTSVIPDSFMGYRDDITMQMSMVLDQIRAPLIVPALRLGVYICLTMSVMLFVERVYMGIVISLVKLFGRKPDKRFKYEPIKDDIELGNSAYPMVLIQIPMFNEREVYQLSIGAACGLSWPSDRIVIQVLDDSTDPTIKDLVEMECSRWASKGVNIKYEIRDNRNGYKAGALKEGMKKSYVKSCDYVAIFDADFQPEADFLWRTVPYLLHNPKLALVQARWKFVNSDECLMTRMQEMSLDYHFTVEQEVGSSTYAFFGFNGTAGIWRISALNEAGGWKDRTTVEDMDLAVRASLKGWKFLYLGSLKVKNELPSTFKAYRYQQHRWSCGPANLFRKMAFEIMTNKNVTLWKKVHVIYSFFVVRKLVAHIVTFIFYCVILPATVLVPEVTVPKWGAVYIPSVITLLNAVGTPRSLHLMVFWILFENVMSLHRTKATFIGLLEGGRVNEWIVTEKLGDVKAKSATKTSKKVIRFRFGDRIHVLELGVGMYLLFVGCYDAFFGKNHYYLYLFAQAIAFFIAGFGQIGTIVPNH

SEQ ID NO: 41 - protein, 712 aa, Arabidopsis thaliana
MNQNNSVWVVAFLCESFFSFIWLLITSIKWSPASYKSYPERLDERVHDLPSVDMFVTTADPVREPPILVANTLLSLLAVNYPANKLACYVSDDGCSPLTYFSLKEASKFAKIWVPFCKKYNIKVRAPFRYFLNPPAATESSEFSKDWEITKREYEKLSRRVEDATGDSHWLDAEDDFEDFSNTKPNDHSTIVKVVWENKGGVGVENEVPHFVYISREKRPNYLHHYKAGAMNFLVRVSGLMTNAPYMLNVDCDMYANEADVVRQAMCIFLQKSMNSNHCAFVQFPQEFYDSNADELTVLQSYLGRGIAGIQGPTYAGSGCFHTRRVMYGLSIDDLEDDGSLSSLATRKYLAEENLAREFGNSNEMVTSVVEALQRKPNPQNTLANSLEAAQEVGHCHFEYQTSWGKTIGWLYESTAEDANTSIGIHSRGWTSSYISPKPPAFLGAMPPGGPEAMLQQRRWATGLLEVLFNKQSPLIGMFCRKIRFRQSLAYLYIFTWGLRSIPELIYCLLPAYCLLHNAALFPKGVYLGIVVTLVGMHCLYSLWEFMSLGFSVQSWFASQSFWRIKTTCSWLFSIPDIILKLLGISKTVFIVTKKTMPKTMSGSGSEKSQREVDCPNQDSGKFEFDGSLYFLPGTFILLVNLAALAGCSVGLQRHRGGGSGLAEACGCILVVILFLPFLKGMFEKGKYGIPWSTLSKAAFLAVLFVVFSVGN

SEQ ID NO: 42 - protein, 755 aa, Arabidopsis thaliana
MAESSSPLPPLCERISHKSYFLRAVDLTILGLLLSLLLYRILHVNQKDTVWIVAFLCETCFTFVWLLITNIKWSPADYKTYPERLDERVHELPPVDMFVTTADPVREPPLIVVNTVLSLLAVNYPANKLACYVSDDGCSPLTYFSLKEASKFAKIWVPFCKKYNVRVRAPFMYFRNSPEAAEGSEFSKDWEMTKREYEKLSQKVEDATGSSHWLDAEDDFEAFLNTKSNDHSTIVKVVWENKGGVGDEKEVPHVVYISREKRPNHFHHYKAGAMNFLVRVSGLMTNAPYMLNVDCDMYVNEADVVRQAMCIFLQKSMDSNHCAFVQYPQDFYDSNVGELTVLQLYLGRGIAGIQGPQYAGSGCFHTRRVMYGLSLDDLGDDGSLSSIATRKYLAEESLTREFGNSKEMVKSVVDALQRKPFPQKNLKDSLETAQEMGHCHYEYQTSWGKNIGWLYDSTTEDVNTSIGIHSRGWTSSYIFPDPPAFLGCMPQGGPEVMVQQRRWATGLLEILFNKQSPLIGMFCRKIRFRQSLAYLYVFSWGLRSIPELFYCLLPAYCLLHNSALFPKGVYLGIIITLVGIHCLYTLWEFMNLGFSIQSWYVTQSFGRIKTTCSWLFSVLDVILKLLGISKTVFIVTKKTMPETKSGSGSKKSQREVDCPNQDSGKFEFDGSLYFLPGTFIVLVNLAALAGCLVGLQSRGGGGSGLAEACGCILVVILFLPFLKGMFEKGKYGIPFSTLSKAAFLAALFVVLSVGN

SEQ ID NO: 43 - protein, 748 aa, Arabidopsis thaliana
MADSSFSLPPLCERISYTNYFLRAVYLTVLGLFFSLLLHRIRHTSEYDNVWLVAFFCESCFFLVCLLITCLKWSPADTKPFPDRLDERVHDLPSVDMFVPTADPVREPPIMVVDTVLSLLAVNYPANKLACYVSDDGCSPLTYFSLKEASKFAKIWVPFCKKYNTRVRAPSRYFLKPISVATEDYEFNRDWEKTKREYEKLRRKVEDATGDSHMLDVEDDFEAFSNTKPNDHSTLVKVVWENKGGVGDEKEIPHIIYISREKRPNYVHNQKCGAMNFLARVSGLMTNAPYILNVDCDMYANDADVVRQAMCILLQESLNMKHCAFVQFRQEFYDSSTELIVVLQSHLGRGIAGIQGPIYIGSGCVHTRRVMYGLSPDDFEVDGSLSSVATREFLVKDSLARRFGNSKEMMKSVVDAIQRNPNPQNILTNSIEAAREVGHFMQIGWLYDSVAEDLNTSIGIHSRGWTSSYISPDTPAFLGSMPAGVPEALLQQRRWATGWIEILFNKQSPLRGLFSKKIRFRQRLAYLCIITCLRSIPELIYCLLPAYCLLHNSTLFPKGLYLGITVTLVGIHCLYTLWEFMSLGYSVQSWLVSQSVWRIVATSSWLFSIFDITLKLLGISETVFIITKKTVAGTKSALGSGPSQGEDVGPNSDLFKFEFDGSLCFLPGTFIVLVNIAALAVFSVGLQRSSYSHEGGGSGLAEACGCVLVMMLFLPFLMGLFKKGKYGTPLSTLSIAGFLAVLFVVFSV

SEQ ID NO: 44 - protein, 757 aa, Arabidopsis thaliana
MADSSCSLPPLYENISYKSYILRAVDLTILGLLFSLLLHRILYMSQNGIIWLVAFLCESCFSFVWLLSTCTKWSPAETKPYPDRLDERVYDLPSVDMFVPTADPVREPPIMVVNTVLSLLAVNYPANKLACYVSDDGCSPLTYFSLKEASKFAKIWVPFCKKYNLKVRAPFRYFLNPFAATEGSEFSRDWEMTKREYEKLCRKVEDATGDSHLLGTDNELEAFSNTKPNDHSTIIKVVWENKGGVGDEKEVPHIVYISREKRPNYLHHYKAGAMNFLARVSGLMTNAPYMLNVDCDMYANEADVVRQAMCIFLQKSQNQNHCAFVQFPQEFYDSNTIKLTVIKSYMGRGIAGIQGPINVGSGCFHSRRVMYGLSPDELEDNGSLSSVATRELLAEDSLSSGFGNSKEMVTSVVEALQRKPNPQNILTNSIEAAQEVGHCDYESQTSWGKTIGWLYDSMSEDMNTSIGIHSRGWTSSYIAPDPPAFLGSMPPGGLEAMIQQRRWATGSIEVLFNKQSPLLGLFCRKLRFRQRVAYLCVSICVRSIPELIYCLLPAYCLLHNSALFPKGLCLGITMLLAGMHCLYTLWEFMCLGHSIQSWYVSQSFWRIVATSSWLFSIFDIILKLLGLSKNVFLVSKKTMPVETMSGSGIGPSQREDDGPNSGKTEFDGSLYFLPGTFIVLVNLAALVGVFVGLQRSSYSHGGGGSGLGEACACILVVMLFFPFLKGLFAKGKYGIPLSTLSKAGFLAVSFVVFSVGN

SEQ ID NO: 45 - protein, 757 aa, Arabidopsis thaliana
MADSSSSLHPLCERISHKSYVLRAVDLTILGLLYSLLLYRILHISENDNVWLLAFFCESCFSLVWLIFTCLKWSPAEDIPYINTLNERVHDLPSLDMFVPTADTVRESPIITVNTVLSLLAVNYPANKLACYVSDDGCSPLTYFSLKEASKFVKIWAPFCKKYNVRVRAPFRYFLNPLVATDDSVFSKDWKMMKREYVKLCRKVEDATGDSHWLDADDDFEAFSNTKPNDHSTIVKVVWENKGGVGDEKEVPHLVYISREKRPNYLHHYKTGAMNFLLRVSGLMTNAPYTLNVDCDMYANEPDVVRQAMCVFLQNSKNSNHCAFVQFPQKFYDSYTNELAVLQSILGRGVAGIQGPFYIGTGCFHTRRVMYGLSSDDLEDNGNISQVATREFLAEDSLVRKYGNSKELVKSVVDALQRKSNPQKSLANLIEAAQEVGHCHYEYQTSWGNLGWMYDSVAEDINTSVGIHLRGWTSSFISPDPPAFIGSTPTLGLEAIVQQRRWATGAIEVLFNKQSPFMGMFHGKIKFRQRLAYFWALMCLRSIPELIYCLLPAYCLLHDSALFPKGPCLCTIVTLVGMHCLYSLWQFMSLGFSVQSWYVVQSLWRIIATSSWLFSIQDIILKLLGISQIGFVIAKKTIPETKSVYESKPSQGEDDVPKLNLGKFEFDSSGLFIPGTFIMLVNLAALAGYLVRLQRSSCSHGGGGSGLAEACGCILVVMLFLPFLKGLFEHGKYSIPLSTLSKAAFLTVLFVFFCVGK

SEQ ID NO: 46 - protein, 828 aa, Arabidopsis thaliana
MADSSSSLLPLCERISHKSYILRIVDLTILVLLFSLLWYRILHMCENNTIWLVAFLCESCFSFMWLIITCIKWSPAEDKPYPNRLDERVHDLPSVDMFVPTADPVREPPIIVVNTVLSLLAVNYPANKLACYVSDDGCSPLTYFSLKEASKFVKIWAPFCKKYNVRVRAPFRYFLNPLVATDDSVFSKDWKMMKIYKVFYYVYFCINMKREYVKLCRKVEDATGDSHWLDADDDFEAFSNTKPNDHSTIVKVLLKLFLKTTVRVFVQFSKVMYILKLIIVVWENKGGVGDEKEVPHLVYISREKRPNYLHHYKTGAMNFLVNDFYLTHLSFFDILIYLKINVNDCRAVSFCYYDKNMMSLIYNFKQLRVSGLMTNAPYMLNVDCDMYANEPDVVRQAMCVFLQNSKNSNHCAFVQFPQNFYDSYTNELVVLQHYMKRGVAGIQGPIYIGSGCFHTRRVMYGLSSDDLEDDGSLSSVASREFLSEDSLVRKYGSSKELVKSVVDALQRKSNPQKSLANLVEAAQEVGHCHYEYQTSWGNLGWLYDSVAEDTNTSIGIHLRGWTSSFISPDPPAFLGSTPSVGPEAIVQHRRWATGSIEVLFNKQSPLIGFRRKIKFRQRLAYFWVLMCIRSIPELVYCLLPAYCLLNNSALFPKGPCLGIIVTLVGMHCLYTLWQFMILGFSVKSCWLFSIQDIILKLLGISKIGFIVAKKNMPETRSGYESKSKPSQGEDDGLKLELAGFLVRLQRSSYSHGGGGGSALAETCGCAMIVFGENDGSQEGLELPKLNSKRGISSIVEKTFVACILPFVRNHKVNEKKNHHINIDRPNLL

SEQ ID NO: 47 - protein, 699 aa, Arabidopsis thaliana
MAPKFEWWAKGNNNNTRKGTPVVVKMENPNNWSMVELESPSHDDFLVRTHEKSRNKNARQLTWVLLLKAHRAAGCLTSLGSALFALGTAVRRRIAAGRTDIEISSSGVGSLQKQNHTKKSKLFYSCLKVFLWLSLILLGFEIAAYFKGWSFGTSKLQLQFIFNKGFFDWVYTRWVLLRVEYLAPPLQFLANGCIVLFLVQSLDRLILCLGCFWIRFKKIKPVPKPDSISDLESGDNGAFLPMVLVQIPMCNEKEVYQQSIAAVCNLDWPKGKILIQILDDSDDPITQSLIKEEVHKWQKLGARIVYRHRVNREGYKAGNLKSAMNCSYVKDYEFVAIFDADFQPLPDFLKKTIPHFKDNEEIGLVQARWSFVNKEENLLTRLQNINLAFHFEVEQQVNSVFLNFFGFNGTAGVWRIKALEDSGGWLERTTVEDMDIAVRAHLHGWKFVFLNDVECQCELPESYEAYRKQQHRWHSGPMQLFRLCLPAVIKSKISIGKKFNLIFLFFLLRKLILPFYSFTLFCIILPMTMFVPEAELPAWVVCYIPATMSFLNILPAPKSFPFIVPYLLFENTMSVTKFNAMVSGLFQLGSAYEWVVTKKSGRSSEGDLAALVEKDEKTTKHQRGVSAPETEAEKKAEKTKRKKKKHNRIYMKELSLAFLLLTAATRSLLSAQGIHFYFLLFQGISFLLVGLDLIGEQVE

SEQ ID NO: 48 - protein, 673 aa, Arabidopsis thaliana
MAPNSVAVTMEKPDNFSLLEINGSDPSSFPDKRKSISPKQFSWFLLLKAHRLISCLSWLVSSVKKRIAFSAKNINEEEDPKSRGKQMYRFIKACLVISIIALSIEIVAHFKKWNLDLINRPSWEVYGLVEWSYMAWLSFRSDYIAPLVISLSRFCTVLFLIQSLDRLVLCLGCFWIKFKKIEPKLTEESIDLEDPSSFPMVLIQIPMCNEREVYEQSIGAASQLDWPKDRILIQVLDDSDDPNLQLLIKEEVSVWAEKGVNIIYRHRLIRTGYKAGNLKSAMTCDYVKDYEFVTIFDADFTPNPDFLKKTVPHFKGNPELGLVQARWSFVNKDENLLTRLQNINLCFHFEVEQQVNGVFLNFFGFNGTAGVWRIKALEESGGWLERTTVEDMDIAVRAHLNGWKFIYLNDVEVTCELPESYEAYKKQQHRWHSGPMQLFRLCLPSIIKSKISVWKKANLIFLFFLLRKLILPFYSFTLFCIILPLTMFIPEAELPLWIICYVPIFISLLNILPSPKSFPFLVPYLLFENTMSITKFNAMISGLFQFGSAYEWVVTKKTGRSSESDLLAFAEKEEKLHRRNSESGLELLSKLKEQETNLVGQETVKKSLGGLMRPKNKKKTNMVFKKELGLAFLLLTAAARSFLSAHGLHFYFLLFQGLSFLVVGLDLIGEQIS

SEQ ID NO: 49 - protein, 692 aa, Arabidopsis thaliana
MAPRLDFSDWWAKDTRKGTPVVVKMENPNYSVVEIDGPDSAFRPVEKSRGKNAKQVTWVLLLKAHRAVGCLTWLATVFWSLLGAIKKRLSFTHPLGSEKLGRDRWLFTAIKLFLAVSLVILGFEIVAYFRGWHYFQSPSLHIPTSTLEIQSLFHLVYVGWLTLRADYIAPPIKALSKFCIVLFLIQSVDRLVLCLGCFWIKYKKIKPRFDEEPFRNDDAEGSGSEYPMVLVQIPMCNEREVYEQSISAVCQLDWPKDRILVQVLDDSNDESIQQLIKAEVAKWSQKGVNIIYRHRLVRTGYKAGNLKSAMSCDYVEAYEYVAIFDADFQPTPDFLKLTVPHFKDNPELGLVQARWTFVNKDENLLTRLQNINLCFHFEVEQQVNGVFLNFFGFNGTAGVWRIKALEESGGWLERTTVEDMDIAVRAHLHGWKFIYLNDVKVLCEVPESYEAYKKQQHRWHSGPMQLFRLCLGSILTSKIAIWKKANLILLFFLLRKLILPFYSFTLFCIILPLTMFVPEAELPVWVICYIPVFMSFLNLLPSPKSFPFIVPYLLFENTMSVTKFNAMVSGLFQLGSSYEWIVTKKAGRSSESDLLSITEKETPTKKSQLLRGVSDSELLELSQLEEQKQAVSKKPVKKTNKIYHKELALAFLLLTAALRSLLAAQGVHFYFLLFQGVTFLLVGLDLIGEQMS

SEQ ID NO: 50 - protein, 682 aa, Arabidopsis thaliana
MSRSQNEEFQQWWNKQRDRNNHDVLYAGDDEAFLTVEIRTPATVDPDKDRIRTRTVRQLSRLYLLKFKQLASSFLWIGNSFLYLVRTANRRIANDNPPSVSSSARLYRLIKGFLVVVVLLLCFELAAYFKGWHFTPPSVASAEVAVEVVYAWWLEIRASYLAPPLQSLTNVCIVLFLIQSVDRLVLVLGCFWIKLRRIKPVASMEYPTKLVGEGVRLEDYPMVIVQIPMCNEKEVYQQSIGAVCMLDWPRERMLVQVLDDSSELDVQQLIKAEVQKWQQRGVRIVYRHRLIRTGYKAGNLKAAMNCEYVKDYEFVAIFDADFQPPADFLKKTVPHFKGNEELALVQTRWAFVNKDENLLTRLQNINLSFHFEVEQQVNGVFINFFGFNGTAGVWRIKALEDCGGWLERTTVEDMDIAVRAHLCGWKFIYLNDVKCLCELPESYEAYKKQQYRWHSGPMQLFRLCFFDILRSKVSAAKKANMIFLFFLLRKLILPFYSFTLFCVILPLTMFFPEANLPSWVVCYIPGIMSILNIIPAPRSFPFIVPYLLFENTMSVTKFGAMISGLFKFDSSYEWVVTKKLGRSSEADLVAYAESGSLVESTTIQRSSSDSGLTELSKLGAAKKAGKTKRNRLYRTEIALAFILLAASVRSLLSAQGIHFYFLLFQGITFVIVGLDLIGEQVS

SEQ ID NO: 51 - protein, 690 aa, Arabidopsis thaliana
MAPRFDFSDLWAKETRRGTPVVVKMENPNYSIVEVEEPDSAFQPMEKSRGKNAKQVTWVLLLKAHKAVGCLTWVATVFWSLLGSVKRRLSFTHPLGSERLGRDGWLFSAIKLFLVASLAILAFELVAYYRGWHYFKNPNLHIPTSKLEIQSLLHLFYVGWLSLRADYIAPPIKALSKFCIVLFLVQSVDRLILCLGCLWIKFKKIKPRIDEEHFRNDDFEGSGSEYPMVLVQIPMCNEREVYEQSISAVCQLDWPKDRLLVQVLDDSDDESIQELIRDEVTKWSQKGVNIIYRHRLVRTGYKAGNLKSAMSCDYVEAYEFVAIFDADFQPNSDFLKLTVPHFKEKPELGLVQARWAFVNKDENLLTRLQNINLCFHFEVEQQVNGVFLNFFGFNGTAGVWRIKALEESGGWLERTTVEDMDIAVRAHLHGWKFIYLNDVKVLCEVPESYEAYKKQQHRWHSGPMQLFRLCLRSILTSKIAMWKKANLILLFFLLRKLILPFYSFTLFCVILPITMFVPEAELPIWVICYVPIFMSLLNILPAPKSFPFIVPYLLFENTMSVTKFNAMVSGLFQLGSSYEWIVTKKAGRSSESDLLALTDKESEKMPNQILRGVSDSELLEISQVEEQKKQPVSVKKTNKIFHKELALAFLLLTAAVRSLLASQGVHFYFLLFQGLTFLLVGLDLIGEQMS

SEQ ID NO: 52 - protein, 1036 aa, Arabidopsis thaliana
MASSPPKKTLNSQSSSLSRPPQAVKFGRRTSSGRIVSLSRDDDMDVSGDYSGQNDYINYTVLMPPTPDNQPAGSSGSTSESKGDANRGGGGGDGPKMGNKLERRLSVMKSNNKSMLLRSQTGDFDHNRWLFESKGKYGIGNAFWSEEDDTYDGGVSKSDFLDKPWKPLTRKVQIPAKILSPYRLLIVIRLVIVFFFLWWRITNPNEDAMWLWGLSIVCEIWFAFSWILDILPKLNPINRATDLAALHDKFEQPSPSNPTGRSDLPGVDVFVSTADPEKEPPLVTANTLLSILAVDYPIEKLSAYISDDGGAILTFEAMAEAVRFAEYWVPFCRKHDIEPRNPDSYFSIKKDPTKNKKRQDFVKDRRWIKREYDEFKVRINGLPEQIKKRAEQFNMREELKEKRIAREKNGGVLPPDGVEVVKATWMADGTHWPGTWFEPKPDHSKGDHAGILQIMSKVPDLEPVMGGPNEGALDFTGIDIRVPMFAYVSREKRPGFDHNKKAGAMNGMVRASAILSNGAFILNLDCDHYIYNSKAIKEGMCFMMDRGGDRICYIQFPQRFEGIDPSDRYANHNTVFFDGNMRALDGLQGPVYVGTGCMFRRYALYGFNPPRANEYSGVFGQEKAPAMHVRTQSQASQTSQASDLESDTQPLNDDPDLGLPKKFGNSTMFTDTIPVAEYQGRPLADHMSVKNGRPPGALLLPRPPLDAPTVAEAIAVISCWYEDNTEWGDRIGWIYGSVTEDVVTGYRMHNRGWRSVYCITKRDAFRGTAPINLTDRLHQVLRWATGSVEIFFSKNNAMFATRRLKFLQRVAYLNVGIYPFTSIFLVVYCFLPALCLFSGKFIVQSLDIHFLSYLLCITVTLTLISLLEVKWSGIGLEEWWRNEQFWLIGGTSAHLAAVVQGLLKVIAGIEISFTLTSKASGEDEDDIFADLYIVKWTGLFIMPLTIIIVNLVAIVIGASRTIYSVIPQWGKLMGGIFFSLWVLTHMYPFAKGLMGRRGKVPTIVYVWSGLVSITVSLLWITISPPDDVSGSGGISV

SEQ ID NO: 53 - protein, 1145 aa, Arabidopsis thaliana
MASNKHFDKSRSNLSNNSDIQEPGRPPAGHSVKFAQRTSSGRYINYSRDDLDSELGGQDFMSYTVHIPPTPDNQPMDPSISQKVEEQYVANSMFTGGFKSNTRAHLMHKVIETEPNHPQMAGSKGSSCAIPGCDAKVMSDERGQDLLPCECDFKICRDCFIDAVKTGGGICPGCKEPYKNTHLTDQVDENGQQRPMLPGGGGSKMERRLSMVKSTNKSALMRSQTGDFDHNRWLFETTGTYGYGNAFWTKDGDFGSGKDGDGDGDGMGMEAQDLMSRPWRPLTRKLKIPAGVISPYRLLIFIRIVVLALFLTWRVKHQNPDAVWLWGMSVVCELWFALSWLLDQLPKLCPINRATDLQVLKEKFETPTASNPTGKSDLPGFDVFVSTADPEKEPPLVTANTILSILAAEYPVEKLSCYVSDDGGALLTFEAMAEAASFANIWVPFCRKHAIEPRNPDSYFSLKRDPYKNKVKSDFVKDRRRVKREFDEFKVRVNSLPDSIRRRSDAYHAREEIKAMKMQRQNRDDEPMEPVKIPKATWMADGTHWPGTWLTSASDHAKGDHAGIIQVMLKPPSDEPLHGVSEGFLDLTDVDIRLPLLVYVSREKRPGYDHNKKAGAMNALVRASAIMSNGPFILNLDCDHYIYNSEALREGMCFMMDRGGDRLCYVQFPQRFEGIDPSDRYANHNTVFFDVNMRALDGLMGPVYVGTGCLFRRIALYGFNPPRSKDFSPSCWSCCFPRSKKKNIPEENRALRMSDYDDEEMNLSLVPKKFGNSTFLIDSIPVAEFQGRPLADHPAVKNGRPPGALTIPRELLDASTVAEAIAVISCWYEDKTEWGSRIGWIYGSVTEDVVTGYRMHNRGWKSVYCVTKRDAFRGTAPINLTDRLHQVLRWATGSVEIFFSRNNALLASSKMKILQRIAYLNVGIYPFTSIFLIVYCFLPALSLFSGQFIVQTLNVTFLVYLLIISITLCLLALLEIKWSGISLEEWWRNEQFWLIGGTSAHLAAVLQGLLKVVAGVEISFTLTSKSGGDDIDDEFADLYMVKWTSLMIPPITIIMVNLIAIAVGFSRTIYSVVPQWSKLIGGVFFSFWVLAHLYPFAKGLMGRRGRTPTIVYVWSGLVAITISLLWVAINPPAGNTEIGGNFSFP

SEQ ID NO: 54 - protein, 1145 aa, Arabidopsis thaliana
MASNNHFMNSRSNLSTNSDAAEAERHQQPVSNSVTFARRTPSGRYVNYSRDDLDSELGSVDLTGYSVHIPPTPDNQPMDPSISQKVEEQYVSNSLFTGGFNSVTRAHLMEKVIDTETSHPQMAGAKGSSCAVPGCDVKVMSDERGQDLLPCECDFKICRDCFMDAVKTGGMCPGCKEPYRNTDLADFADNNKQQRPMLPPPAGGSKMDRRLSLMKSTKSGLMRSQTGDFDHNRWLFETSGTYGFGNAFWTKDGNFGSDKDGNGHGMGPQDLMSRPWRPLTRKLQIPAAVISPYRLLILIRIVVLALFLMWRIKHKNPDAIWLWGMSVVCELWFALSWLLDQLPKLCPINRATDLNVLKEKFETPTPSNPTGKSDLPGLDMFVSTADPEKEPPLVTSNTILSILAADYPVEKLACYVSDDGGALLTFEAMAEAASFANMWVPFCRKHNIEPRNPDSYFSLKRDPYKNKVKADFVKDRRRVKREYDEFKVRINSLPDSIRRRSDAYHAREEIKAMKLQRQNRDEEIVEPVKIPKATWMADGTHWPGTWINSGPDHSRSDHAGIIQVMLKPPSDEPLHGVSEGFLDLTDVDIRLPLLVYVSREKRPGYDHNKKAGAMNALVRASAIMSNGPFILNLDCDHYIYNSQALREGMCFMMDRGGDRLCYVQFPQRFEGIDPSDRYANHNTVFFDVNMRALDGLMGPVYVGTGCLFRRIALYGFDPPRAKEHHPGFCSCCFSRKKKKSRVPEENRSLRMGGDSDDDEEMNLSLVPKKFGNSTFLIDSIPVAEFQGRPLADHPAVQNGRPPGALTIPRELLDASTVAEAIAVISCWYEDKTEWGSRIGWIYGSVTEDVVTGYRMHNRGWKSVYCVTKRDAFRGTAPINLTDRLHQVLRWATGSVEIFFSRNNAFFASPRMKILQRIAYLNVGIYPFTSFFLIVYCFLPALSLFSGQFIVQTLNVTFLVYLLIISITLCLLALLEIKWSGISLEEWWRNEQFWLIGGTSAHLAAVIQGLLKVVAGIEISFTLTSKSGGEDVDDEFADLYIVKWTSLMIPPITIMMVNLIAIAVGFSRTIYSVIPQWSKLIGGVFFSFWVLAHLYPFAKGLMGRRGRTPTIVYVWSGLVAITISLLWVAINPPAGSTQIGGSFTFP

SEQ ID NO: 55 - protein, 1111 aa, Arabidopsis thaliana
MASTPPQTSKKVRNNSGSGQTVKFARRTSSGRYVSLSRDNIELSGELSGDYSNYTVHIPPTPDNQPMATKAEEQYVSNSLFTGGFNSVTRAHLMDKVIDSDVTHPQMAGAKGSSCAMPACDGNVMKDERGKDVMPCECRFKICRDCFMDAQKETGLCPGCKEQYKIGDLDDDTPDYSSGALPLPAPGKDQRGNNNNMSMMKRNQNGEFDHNRWLFETQGTYGYGNAYWPQDEMYGDDMDEGMRGGMVETADKPWRPLSRRIPIPAAIISPYRLLIVIRFVVLCFFLTWRIRNPNEDAIWLWLMSIICELWFGFSWILDQIPKLCPINRSTDLEVLRDKFDMPSPSNPTGRSDLPGIDLFVSTADPEKEPPLVTANTILSILAVDYPVEKVSCYLSDDGGALLSFEAMAEAASFADLWVPFCRKHNIEPRNPDSYFSLKIDPTKNKSRIDFVKDRRKIKREYDEFKVRINGLPDSIRRRSDAFNAREEMKALKQMRESGGDPTEPVKVPKATWMADGTHWPGTWAASTREHSKGDHAGILQVMLKPPSSDPLIGNSDDKVIDFSDTDTRLPMFVYVSREKRPGYDHNKKAGAMNALVRASAILSNGPFILNLDCDHYIYNCKAVREGMCFMMDRGGEDICYIQFPQRFEGIDPSDRYANNNTVFFDGNMRALDGVQGPVYVGTGTMFRRFALYGFDPPNPDKLLEKKESETEALTTSDFDPDLDVTQLPKRFGNSTLLAESIPIAEFQGRPLADHPAVKYGRPPGALRVPRDPLDATTVAESVSVISCWYEDKTEWGDRVGWIYGSVTEDVVTGYRMHNRGWRSVYCITKRDSFRGSAPINLTDRLHQVLRWATGSVEIFFSRNNAILASKRLKFLQRLAYLNVGIYPFTSLFLILYCFLPAFSLFSGQFIVRTLSISFLVYLLMITICLIGLAVLEVKWSGIGLEEWWRNEQWWLISGTSSHLYAVVQGVLKVIAGIEISFTLTTKSGGDDNEDIYADLYIVKWSSLMIPPIVIAMVNIIAIVVAFIRTIYQAVPQWSKLIGGAFFSFWVLAHLYPFAKGLMGRRGKTPTIVFVWAGLIAITISLLWTAINPNTGPAAAAEGVGGGGFQFP

SEQ ID NO: 56 - protein, 1181 aa, Arabidopsis thaliana
MVKSAASQSPSPVTITVTPCKGSGDRSLGLTSPIPRASVITNQNSPLSSRATRRTSISSGNRRSNGDEGRYCSMSVEDLTAETTNSECVLSYTVHIPPTPDHQTVFASQESEEDEMLKGNSNQKSFLSGTIFTGGFKSVTRGHVIDCSMDRADPEKKSGQICWLKGCDEKVVHGRCECGFRICRDCYFDCITSGGGNCPGCKEPYRDINDDPETEEEDEEDEAKPLPQMGESKLDKRLSVVKSFKAQNQAGDFDHTRWLFETKGTYGYGNAVWPKDGYGIGSGGGGNGYETPPEFGERSKRPLTRKVSVSAAIISPYRLLIALRLVALGLFLTWRVRHPNREAMWLWGMSTTCELWFALSWLLDQLPKLCPVNRLTDLGVLKERFESPNLRNPKGRSDLPGIDVFVSTADPEKEPPLVTANTILSILAVDYPVEKLACYLSDDGGALLTFEALAQTASFASTWVPFCRKHNIEPRNPEAYFGQKRNFLKNKVRLDFVRERRRVKREYDEFKVRINSLPEAIRRRSDAYNVHEELRAKKKQMEMMMGNNPQETVIVPKATWMSDGSHWPGTWSSGETDNSRGDHAGIIQAMLAPPNAEPVYGAEADAENLIDTTDVDIRLPMLVYVSREKRPGYDHNKKAGAMNALVRTSAIMSNGPFILNLDCDHYIYNSMALREGMCFMLDRGGDRICYVQFPQRFEGIDPNDRYANHNTVFFDVSMRALDGLQGPMYVGTGCIFRRTALYGFSPPRATEHHGWLGRRKVKISLRRPKAMMKKDDEVSLPINGEYNEEENDDGDIESLLLPKRFGNSNSFVASIPVAEYQGRLIQDLQGKGKNSRPAGSLAVPREPLDAATVAEAISVISCFYEDKTEWGKRVGWIYGSVTEDVVTGYRMHNRGWRSIYCVTKRDAFRGTAPINLTDRLHQVLRWATGSVEIFFSRNNAIFATRRMKFLQRVAYFNVGMYPFTSLFLIVYCILPAISLFSGQFIVQSLDITFLIYLLSITLTLCMLSLLEIKWSGITLHEWWRNEQFWVIGGTSAHPAAVLQGLLKVIAGVDISFTLTSKSSAPEDGDDEFADLYVVKWSFLMVPPLTIMMVNMIAIAVGLARTLYSPFPQWSKLVGGVFFSFWVLCHLYPFAKGLMGRRGRVPTIVFVWSGLLSIIVSLLWVYINPPSGKQDYMQFQFP

SEQ ID NO: 57 - protein, 979 aa, Arabidopsis thaliana
MMDGESPLRHPRISHVSNSGSDFGSSSDYNKYLVQIPPTPDNNPGPASLSIVLLEIDSNQESVPSVSGDIVSGSSGKDNEPDLTDVRINVGEEEEDDTLLSKISYSLTRVVKISPIIIALYRILIVVRVVSLALFLFWRIRNPNNKALWLWLLSVICELWFAFSWLLDQIPKLFPVNHATDIEALKATFETPNPDNPTGKSDLPGIDVFVSTADAEKEPPLVTANTILSILSVDYPVEKLSVYISDDGGSLVTFEAIAEAASFAKIWVPFCRKHKIEPRNPESYFGLKRDPYKDKVRHDFVRERRYVKRAYDEFKVRVNALPHSIRRRSDAFNSKEEIKALEKWKHWKVKVEEDQIKEPRPALVAPKATWMSDGTHWPGTWAVSGPHHSRGDHASVIQVLLDPPGDEPVEGKGGEGRALDLEGVDIRLPMLVYVSREKRPGYDHNKKAGAMNALVRASAIMSNGPFILNLDCDHYVYNSRAFRDGICFMMDHDGDRVSYVQFPQRFEGIDPSDRYANKNTVFFDINLRALDGIQGPMYVGTGCLFRRTALYGFNPPDVFVVEEEPSGSYCFPLIKKRSPATVASEPEYYTDEEDRFDIGLIRKQFGSSSMLVNSVKVAEFEGRPLATVHSSRLGRPPGSLTGSRKPLDFATVNEAVNVISCWYEDKTEWGFNVGWIYGSVTEDVVTGFRMHEKGWRSFYCVTEPDAFRGSAPINLTDRLHQVLRWATGSVEIFFSRNNAIFAGPKLKLLQRIAYLNVGIYPFTSIFILTYCFLPPLSLFSGHFVVETLTGSFLIYLLIITLSLCGLAVLEVKWSGISLEEWWRNEQFWLIGGTSAHLVAVLQGILKVIAGVEISFTLTSKSSTGGDDEDDEFADLYLFKWTALMIPPLTIIILNIVAILFAVCRTVFSANPQWSNLLGGTFFASWVLLHMYPFAKGLMGRGGKTPTVVYVWSGLIAICLSLLYITIKNSEIDGGSFMLV

SEQ ID NO: 58 - protein, 729 aa, Arabidopsis thaliana
MVNKDDRIRPVHEADGEPLFETRRRTGRVIAYRFFSASVFVCICLIWFYRIGEIGDNRTVLDRLIWFVMFIVEIWFGLYWVVTQSSRWNPVWRFPFSDRLSRRYGSDLPRLDVFVCTADPVIEPPLLVVNTVLSVTALDYPPEKLAVYLSDDGGSELTFYALTEAAEFAKTWVPFCKKFNVEPTSPAAYLSSKANCLDSAAEEVAKLYREMAARIETAARLGRIPEEARVKYGDGFSQWDADATRRNHGTILQVLVDGREGNTIAIPTLVYLSREKRPQHHHNFKAGAMNALLRVSSKITCGKIILNLDCDMYANNSKSTRDALCILLDEKEGKEIAFVQFPQCFDNVTRNDLYGSMMRVGIDVEFLGLDGNGGPLYIGTGCFHRRDVICGRKYGEEEEEEESERIHENLEPEMIKALASCTYEENTQWGKEMGVKYGCPVEDVITGLTIQCRGWKSAYLNPEKQAFLGVAPTNLHQMLVQQRRWSEGDFQIMLSKYSPVWYGKGKISLGLILGYCCYCLWAPSSLPVLIYSVLTSLCLFKGIPLFPKVSSSWFIPFGYVTVAATAYSLAEFLWCGGTFRGWWNEQRMWLYRRTSSFLFGFMDTIKKLLGVSESAFVITAKVAEEEAAERYKEEVMEFGVESPMFLVLGTLGMLNLFCFAAAVARLVSGDGGDLKTMGMQFVITGVLVVINWPLYKGMLLRQDKGKMPMSVTVKSVVLALSACTCLAFL

SEQ ID NO: 59 - protein, 770 aa, Arabidopsis thaliana
METHRKNSVVGNILHTCHPCRRTIPYRIYAIFHTCGIIALMYHHVHSLVTANNTLITCLLLLSDIVLAFMWATTTSLRLNPVHRTECPEKYAAKPEDFPKLDVFICTADPYKEPPMMVVNTALSVMAYEYPSDKISVYVSDDGGSSLTFFALIEAAKFSKQWLPFCKKNNVQDRSPEVYFSSESHSRSDEAENLKTNILKCEVEQMMYEDMKSRVEHVVESGKVETAFITCDQFRGVFDLWTDKFSRHDHPTIIQVLQNSETDMDNTRKYIMPNLIYVSREKSKVSPHHFKAGALNTLLRVSGVMTNSPIILTLDCDMYSNDPATLVRALCYLTDPEIKSGLGYVQFPQKFLGISKNDIYACENKRLFIINMVGFDGLMGPTHVGTGCFFNRRAFYGPPYMLILPEINELKPYRIADKSIKAQDVLSLAHNVAGCIYEYNTNWGSKIGFRYGSLVEDYYTGFMLHCEGWRSVFCNPKKAAFYGDSPKCLVDLVGQQIRWAVGLFEMSFSKYSPITYGIKSLDLLMGLGYCNSPFKPFWSIPLTVYGLLPQLALISGVSVFPKASDPWFWLYIILFFGAYAQDLSDFLLEGGTYRKWWNDQRMLMIKGLSSFFFGFIEFILKTLNLSTPKFNVTSKANDDDEQRKRYEQEIFDFGTSSSMFLPLTTVAIVNLLAFVWGLYGILFCGGELYLELMLVSFAVVNCLPIYGAMVLRKDDGKLSKRTCFLAGNLHVGSYCVKLLRPQVTSPLRLIHNNNTSGWFKRKKHNMNESV

SEQ ID NO: 60 - protein, 730 aa, Arabidopsis thaliana
MEPQRKHSTALHTCHPCRRTIPYRIYAVFHTCGIIALMYHHVHSIVNANNTLITCLLLLSDIVLAFMWATTTSLRLNPIHRTEYPEKYAAKPEDFPKLDVFICTADPYKEPPMMVVNTALSVMAYEYPSHKISVYVSDDGGSSLTLFALMEAAKFSKHWLPFCKNNNVQDRSPEVYFSSKSHSSSDEAENLKIFNCVVEQMMYEDMKSRVEHVVESGKVETAFIACDQFSCVFDLWTDKFTRHDHPTIIMVLQHNETEMMPNLIYVSREKSKVSPHHFKAGALNTLLRVSAVMTNSPIILTLDCDMYSNNPTTPLHALCYLSDPKINFDLGFVQFPQKFQGVNKNDIYASELKRPFDINTVGFDGLMGPVHMGTGCFFNRRAFYGPPTTLILPEIETFGPNRIADKPIKAQDILALAHDVAGCNYECNTNWGSKIGFRYGSLVEDYFTGFMLHCEGWRSIFCSPTKAAFYGDSPKCLTDVIGQQIRWSVGLLEVAFSRYNPLTYGIKPLSLLMSLGYCHYAFWPFWCIPLVVYGILPQVALIHGVSVFPKASDPWFWLYIILFLGGYAQDLSDFLLEGGTYRKWWNDQRMWMVRGLSSFFFGFTEFTLKTLNLSTQGYNVTSKSNDDNEQMKRYEQEIFDFGPSSSMFLPITTVAIMNLLAFMRGLYGIFTWGEGPVLELMLASFAVVNCLPIYEAMVLRIDDGKLPKRICFLAGLLSFVLTGSGYFFLK

SEQ ID NO: 61 - protein, 747 aa, Arabidopsis thaliana
MEPHRKHSVGDTTLHTCHPCRRTIPYRIYAVFHTCGIIALMYHHVHSLLTANTTLITSLLLLSDIVLAFMWATTTSLRYKPVRRTEYPEKYAAEPEDFPKLDVFICTADPYKEPPMMVVNTALSVMAYEYPSDKISVYVSDDGGSSLTLFALMEAAKFSKHWLPFCKKNNVQDRSPEVYFSSKLRSRSDEAENIKMMYEDMKSRVEHVVESGKVETAFITCDQFRGVFDLWTDKFTRHDHPTIIQVLQNSENDMDDTKKYIMPNLIYVSREKSKVSSHHFKAGALNTLLRVSGVMTNSPIILTLDCDMYSNDPATPVRALCYLTDPKIKTGLGFVQFPQTFQGISKNDIYACAYKRLFEINMIGFDGLMGPNHVGTGCFFNRRGFYGAPSNLILPEIDELKPNRIVDKPINAQDVLALAHRVAGCIYELNTNWGSKFVIPYNFILSFKTMQIGFRYGSLVEDYYTGYRLHCEGWRSVFCRPKRAAFCGDSPKSLIDVVSQQKRWAIGLLEVAISRYSPITYGVKSMGLVTGVGYCQYACWAFWSLPLIVYGFLPQLALLYQSSVFPKSSDPWFWLYIVLFLGAYGQDLLDFVLEGGTYGGWWNDQRMWSIRGFSSHLFGFIEFTLKTLNLSTHGFNVTSKANDDEEQSKRYEKEIFEFGPSSSMFLPLTTVAIVNLLAFVWGLYGLFAWGEGLVLELMLASFAVVNCLPIYEAMVLRIDDGKLPKRVCFVAGILTFVLIVSGYVFLK

SEQ ID NO: 62 - protein, 380 aa, Arabidopsis thaliana
PLVIYRIIVLRLVLLYRIVLWLMSVIEIWFALWLLKPIRLDLRESLVDVFVTDPMEPPLVNTILSILALDYPDKLSCYVSDDGALTFEALEAFAWVPFCKKIRPYFDKEYEVRIESKVWHIIVLPLVYVSREKRPGYHKAGAMNLVRSAVLTNAYVLNLDCDYNNSLRAMCFLMDVAYVQFPQRFIDDYNLTVDINLGLGVQGPVYVGTGCFFRNALYGVEGVCYETWGIGWIYSVEDMTGVRMHRGWKSVYLAFKGAPLDLQQRWAGSVEIFSRILLLRAYLYLSILLYLPLLFIWIYILISLLILESGIWWEQWISALALLKVLAGFVTSKGDELYTLIPIIVNLVAVGKIFVIVLYPFGLMRRIVFVWLLAFLLWVI

SEQ ID NO: 63 - protein, 526 aa, Ct
MRNLIFEEPEGIPGNSSSSLRYAWQSIRAPVIIPLLKLAVIVCSVMSIMLFVERVAMAAVILIVKVLRKKRYTKYNLEAMKQKLERSKKYPMVLIQIPMYNEKEVYKLSIGAVCGLSWPADRFIVQVLDDSTNPVLRELVEMECQKWIQKGVNVKYENRRNRNGYKAGALKEGLEKQYVEDCEFVAIFDADFQPDADFLWNTIPYLLENPKLGLVQARWKFVNSEECMMTRLQEMSLDYHFSVEQEVGSSTYSFFGFNGTAGVWRIQAIKDAGGWKDRTTVEDMDLAVRASLHGWEFVFVGDVKVKNELPSTFKAYRFQQHRWSCGPANLFKKMTKEIICCKRVPLLKRLHLIYAFFFVRKIVAHWVTFFFYCIVIPACVIVPEVNLKKQIAIYIPATITILNAVSTPRSMHLLVLWILFENVMSLHRTKAAIIGLLEANRVNEWVVTEKLGNAMKQRNNARPSRASRFRIIERIHPLEIIVGMYMLHCATYDLLFGHDHFFVYLLLQAGAFFTMGFGLVGTIVPT

SEQ ID NO: 64 - protein, 521 aa, Oryza sativa
MEVNGGGAAGLPEAWSQVRAPVIVPLLRLAVAVCLTMSVLLFLERMYMAVVISGVKILRRRPDRRYRCDPIPDDDPELGTSAFPVVLIQIPMFNEREVYQLSIGAVCGLSWPSDRLVVQVLDDSTDPVIKEMVRIECERWAHKGVNITYQIRENRKGYKAGALKEGMKHGYVRECEYVAIFDADFQPDPDFLRRTIPFLVHNSDIALVQARWRFVNADECLMTRMQEMSLDYHFTVEQEVSSSVCAFFGFNGTAGVWRVSAVNEAGGWKDRTTVEDMDLAIRASLKGWKFVYLGDVQVKSELPSTFKAFRFQQHRWSCGPANLFRKMLMEIVRNKKVTIWKKIHVIYNFFLIRKIIAHIVTFAFYCLIIPATIFVPEVRIPKWGCVYIPTIITLLNSVGTPRSFHLLFFWILFENVMSLHRTKATLIGLLEAGRANEWVVTEKLGNALKMKSSSKSSAKKSFMRVWDRLNVTELGVAAFLFSCGWYDLAFGKDHFFIYLFFQGAAFFIVGIGYVGTIVPQS

SEQ ID NO: 65 - protein, 594 aa, Oryza sativa
MSSSGGGGVAEEVARLWGELPVRVVWAAVAAQWAAAAAAARAAVVVPAVRALVAVSLAMTVMILAEKLFVAAVCLAVRAFRLRPDRRYKWLPIGAAAAAASSEDDEESGLVAAAAAFPMVLVQIPMFNEREVYKLSIGAACSLDWPSDRVVIQVLDDSTDLVVKVFIVIYFTDISSRIIRSTSSLVIKDLVEKECQKWQGKGVNIKYEVRGNRKGYKAGALKEGLKHDYVKECEYIAMFDADFQPESDFLLRTVPFLVHNSEIALVQTRWKFVNANECLLTRFQEMSLDYHFKYEQEAGSSVYSFFGFNGTAGVWRIAAIDDAGGWKDRTTVEDMDLAVRATLQGWKFVYVGDVKVKSELPSTFKAYRFQQHRWSCGPANLFKKMMVEILENKKVSFWNKIHLWYDFFFVGKIAAHTVTFIYYCFVIPVSVWLPEIEIPLWGVVYVPTVITLCKAVGTPSSFHLVILWVLFENVMSLHRIKAAVTGILEAGRVNEWVVTEKLGDANKTKPDTNGSDAVKVIDVELTTPLIPKLKKRRTRFWDKYHYSEIFVGICIILSGFYDVLYAKKGYYIFLFIQGLAFLIVGFDYIGVCPP

SEQ ID NO: 66 - protein, 529 aa, Oryza sativa
MASSSSSSLPAAWAAAVRAWAVAPALRAAVWACLAMSAMLVAEAAWMGLASLAAAAARRLRGYGYRWEPMAAPPDVEAPAPAPAEFPMVLVQIPMYNEKEVYKLSIGAACALTWPPDRIIIQVLDDSTDPFVKFSLVQELVELECKEWASKKINIKYEVRNNRKGYKAGALRKGMEHTYAQLCDFVAIFDADFEPESDFLLKTMPYLLHNPKIALVQTRWEFVNYNVCLMTRIQKMSLDYHFKVEQESGSFMHAFFGFNGTAGVWRVSAINQSGGWKDRTTVEDMDLAVRASLKGWEFLYVGDIRVKSELPSTFQAYRHQQHRWTCGAANLFRKMAWEIITNKEVSMWKKYHLLYSFFFVRRAIAPILTFLFYCIVIPLSAMVPEVTIPVWGLVYIPTAITIMNAIRNPGSVHLMPFWILFENVMAMHRMRAALSGLLETARANDWVVTEKVGDQVKDELDVPLLEPLKPTECAERIYIPELLLALYLLICASYDFVLGNHKYYIYIYLQAVAFTVMGFGFVGTRTPCS

SEQ ID NO: 67 - protein, 611 aa, Oryza sativa
MAMAGADGPTAGAAAAVRWRGGESLLLLLLRWPSSAELVAAWGAARASAVAPALAAASAACLALSAMLLADAVLMAAACFARRRPDRRYRATPLGAGAGADDDDDDEEAGRVAYPMVLVQIPMYNEREVYKLSIGAACGLSWPSDRLIVQVLDDSTDPTVKTWYDRLRKTLVQQAHPAQADMDVHQSTKRKNKELMTRVPILECDSNHGLASIISSYLIAVGLVELECKSWGNKGKNVKYEVRNTRKGYKAGALKEGLLRDYVQQCNYVAIFDADFQPEPDFLLRTIPYLVRNPQIGLVQAHWEFVNTSECLMTRIQKMTLHYHFKVEQEGGSSTFAFFGFNGTAGVWRISALEEAGGWKDRTTVEDMDLAVRAGLKGWKFVYLADVKVKSELPSNLKTYRHQQHRWTCGAANLFRKVGAEILFTKEVPFWWKFYLLYSFFFVRKVVAHVVPFMLYCVVIPFSVLIPEVTVPVWGVVYVPTTITLLHAIRNTSSIHFIPFWILFENVMSFHRTKAMFIGLLELGGVNEWVVTEKLGNGSNTKPASQILERPPCRFWDRWTMSEILFSIFLFFCATYNLAYGGDYYFVYIYLQAIAFLVVGIGFCGTISSNS

SEQ ID NO: 68 - protein, 549 aa, Oryza sativa
MEGQWGRWRLAAAAAASSSGDQIAAAWAVVRARAVAPVLQFAVWACMAMSVMLVLEVAYMSLVSLVAVKLLRRVPERRYKWEPITTGSGGVGGGDGEDEEAATGGREAAAFPMVLVQIPMYNEKEVYKLSIGAACALTWPPDRIIIQVLDDSTDPAIKDLVELECKDWARKEINIKYEIRDNRKGYKAGALKKGMEHIYTQQCDFVAIFDADFQPESDFLLKTIPFLVHNPKIGLVQTRWEFVNYDVCLMTRIQKMSLDYHFKVEQESGSSMHSFFGFNGTAGVWRVSAINEAGGWKDRTTVEDMDLAVRASLKGWQFLYVGDIRVKSELPSTFKAYRHQQHRWTCGAANLFRKMATEIAKNKGVSVWKKLHLLYSFFFVRRVVAPILTFLFYCVVIPLSVMVPEVSIPVWGMVYIPTAITIMNAIRNPGSIHLMPFWILFENVMAMHRMRAALTGLLETMNVNQWVVTEKVGDHVKDKLEVPLLEPLKPTDCVERIYIPELMVAFYLLVCASYDLVLGAKHYYLYIYLQAFAFIALGFGFAGTSTPCS

SEQ ID NO: 69 - protein, 574 aa, Oryza sativa
MEAGEAAGAVLFLLAAAVSLLAAVSTGALDFTYLVTVVGEGSSTSPGSGGGAWWREAWVGARSRAVAPALQVGVWACMVMSVMLVVEATYNSAVSVAARLVGWRPERWFKWEPLGGGAGAGDEEKGEAAAAAYPMVMVQIPMYNELEVYKLSIGAVCGLKWPKERLIIQVLDDSTDAFIKNLVELECEDWASKGLNIKYATRSGRKGFKAGALKKGMEWDYAKQCEYVAIFDADFQPEPDFLLRTVPFLMHNQNVALVQARWVFVNDRVSLLTRIQKTFLDYHFKAEQEAGSATFAFFSFNGTAGVWRTEAINDAGGWKDRTTVEDMDLAVRATLKGWKFIYLGDLRVKSELPSTYKAYCRQQFRWSCGGANLFRKMIWDVLVAKKVSSLKKIYILYSFFLVRRVVAPAVAFILYNVIIPVSVMIPELFLPIWGVAYIPTALLIVTAIRNPENLHTVPLWILFESVMSMHRLRAAVAGLLQLQEFNQWIVTKKVGNNAFDENNETPLLQKSRKRLINRVNLPEIGLSVFLIFCASYNLVFHGKNSFYINLYLQGLAFFLLGLNCVGTLPDHCCF

SEQ ID NO: 70 - protein, 534 aa, Oryza sativa
MQGDLALRAGGDRLLVADTVAAVVESLVQAWRQVRMELLVPLLRGAVVACMVMSVIVLAEKVFLGVVSAVVKLLRRRPARLYRCDPVVVEDDDEAGRASFPMVLVQIPMYNEKEVYQLSIGAACRLTWPADRLIVQVLDDSTDAIVKELVRKECERWGKKGINVKYETRKDRAGYKAGNLREGMRRGYVQGCEFVAMLDADFQPPPDFLLKTVPFLVHNPRLALVQTRWEFVNANDCLLTRMQEMSMDYHFKVEQEAGSSLCNFFGYNGTAGVWRRQVIDESGGWEDRTTAEDMDLALRAGLLGWEFVYVGSIKVKSELPSTLKAYRSQQHRWSCGPALLFKKMFWEILAAKKVSFWKKLYMTYDFFIARRIISTFFTFFFFSVLLPMKVFFPEVQIPLWELILIPTAIILLHSVGTPRSIHLIILWFLFENVMALHRLKATLIGFFEAGRANEWIVTQKLGNIQKLKSIVRVTKNCRFKDRFHCLELFIGGFLLTSACYDYLYRDDIFYIFLLSQSIIYFAIGFEFMGVSVSS

SEQ ID NO: 71 - protein, 585 aa, Oryza sativa
MVEAGEIGGAAVFALAAAAALSAASSLGAVDFRRPLAAVGGGGAFEWDGVVPWLIGVLGGGDEAAAGGVSVGVAAWYEVWVRVRGGVIAPTLQVAVWVCMVMSVMLVVEATFNSAVSLGVKAIGWRPEWRFKWEPLAGADEEKGRGEYPMVMVQIPMYNELEVYKLSIGAACELKWPKDKLIVQVLDDSTDPFIKNLVELECESWASKGVNIKYVTRSSRKGFKAGALKKGMECDYTKQCEYIAIFDADFQPEPNFLLRTVPFLMHNPNVALVQARWAFVNDTTSLLTRVQKMFFDYHFKVEQEAGSATFAFFSFNGTAGVWRTTAINEAGGWKDRTTVEDMDLAVRASLNGWKFIYVGDIRVKSELPSTYGAYCRQQFRWACGGANLFRKIAMDVLVAKDISLLKKFYMLYSFFLVRRVVAPMVACVLYNIIVPLSVMIPELFIPIWGVAYIPMALLIITTIRNPRNLHIMPFWILFESVMTVLRMRAALTGLMELSGFNKWTVTKKIGSSVEDTQVPLLPKTRKRLRDRINLPEIGFSVFLIFCASYNLIFHGKTSYYFNLYLQGLAFLLLGFNFTGNFACCQ

SEQ ID NO: 72 - protein, 541 aa, Oryza sativa
MMSGGLAWAWRAVRCGVVLPTLQLAVYVCVAMSIMLFLERLYMALVVAALWLIRRRRRRSNRREQDDDGAENDQLLQDPEAANSPMVLVQIPMFNEKQVYRLSIGAACGMTWPSDKLVIQVLDDSTDPAIREMVEGECGRWAGKGVSIRYENRRNRSGYKAGAMREGLRKAYARECELVAIFDADFQPDADFLLRTVPVLVADPGVALVQARWRFVNADECLLTRIQEMSLDYHFRVEQEVGSACHGFFGFNGTAGVWRVRALEEAGGWKERTTVEDMDLAVRASLRGWRFVYVGHVGVRNELPSTLRAYRYQQHRWSCGPANLFRKIFLEAPPPACPPGRSSTSSTISSSSASSSPTSSPSPSTASSSPPASSPAPTTSASPSTSPSTSPPPSPSSTPPAPRAPAISSSSGSSSRTSCPCTGPRPRSSACSRPPAPTSGSSPTSEATPTPSTSSQLIPPPGLGGRPPPAPAAQASSIMTSMSPRSSWGPACSTAPSTTSPTAATASTSTCSSSRPPPSSSASATSGPSSYYYSYSTCIHV

SEQ ID NO: 73 - protein, 527 aa, Oryza sativa
MAAAGAVLPEQIAAMWEQVKAPVVVPLLRLSVAACLAMSVMLFVEKVYMSVVLVGVHLFGRRPDRRYRCDPIVAAGADNDDPELADANAAFPMVLIQIPMYNEREVYKLSIGAACGLSWPSDRVIVQVLDDSTDPVIKEMVQVECKRWESKGVRIKYEIRDNRVGYKAGALREGMKHGYVRDCDYVAIFDADFQPDPDFLARTIPFLVHNPDIALVQARWKFVNANECLMTRMQEMSLDYHFKVEQEVGSSTHAFFGFNGTAGVWRISAMNEAGGWKDRTTVEDMDLAVRAGLKGWKFVYLGDLMVKSELPSTFKAFRYQQHRWSCGPANLFRKMLVEIATNKKVTLWKKIYVIYNFFLVRKIIGHIVTFVFYCLVVPATVLIPEVEIPRWGYVYLPSIVTILNSIGTPRSLHLLIFWVLFENVMSLHRTKATLIGLLETGRVNEWVVTEKLGDALKLKLPGKAFRRPRMRIGDRVNALELGFSAYLSFCGCYDIAYGKGYYSLFLFLQSITFFIIGVGYVGTIVPH

SEQ ID NO: 74 - protein, 690 aa, Oryza sativa
MARWWGGEGRGGSGTPVVVKMESPEWAISEVEAGAAAPGSPAAGGKAGRGKNARQITWVLLLKAHRAAGKLTGAASAALSVAAAARRRVAAGRTDSDDAAAAPPGESPALRARFHGFLRAFLLLSVLLLAVDVAAHAQGWHAVVPDLLAVEGLFAAAYASWLRVRLEYLAPGLQFLANACVVLFLIQSADRLILCLGCLWIKLKGIKPVPKASGGGGGGKGSDDVEAGADEFPMVLVQIPMCNEKEVYQQSIGAVCNLDWPRSNFLVQVLDDSDDAATSALIKEEVEKWQREGVRILYRHRVIRDGYKAGNLKSAMNCSYVKDYEFVVIFDADFQPQADFLKRTVPHFKGNEDVGLVQARWSFVNKDENLLTRLQNINLCFHFEVEQQVNGVFLNFFGFNGTAGVWRIKALEDSGGWMERTTVEDMDIAVRAHLKGWKFLYINDVECQCELPESYEAYRKQQHRWHSGPMQLFRLCFVDIIKSKIGVWKKFNLIFLFFLLRKLILPFYSFTLFCIILPMTMFVPEAELPAWVVCYIPATMSLLNILPAPKSFPFIVPYLLFENTMSVTKFNAMISGLFQLGSAYEWVVTKKSGRSSEGDLVSLVEKQPKQQRVGSAPNLDSLAKESHPKKDSKKKKHNRIYQKELALSFLLLTAAARSLLSVQGIHFYFLLFQGVSFLVVGLDLIGEQVE

SEQ ID NO: 75 - protein, 698 aa, Oryza sativa
MAPPGVGVGVAYLWGKGRGGRKGTPVVVTMESPNYSVVEVDGPDAEAELRTAAVAMDKGGGRGRSRSRTARQLTWVLLLRARRAAGRLASFAAAAARRFRRSPADAADELGRGRGRLMYGFIRGFLALSLLALAVELAAYWNGWRLRRPELHVPEAVEIEGWAHSAYISWMSFRADYIRRPIEFLSKACILLFVIQSMDRLVLCLGCFWIKLRKIKPRIEGDPFREGSGYQHPMVLVQIPMCNEKEVYEQSISAACQLDWPREKFLIQVLDDSSDESIQLLIKAEVSKWSHQGVNIVYRHRVLRTGYKAGNLKSAMSCDYVKDYEFVAIFDADFQPTPDFLKKTIPHFEGNPELGLVQARWSFVNKDENLLTRLQNINLCFHFEVEQQVNGVFLNFFGFNGTAGVWRIQALEESGGWLERTTVEDMDIAVRAHLNGWKFIFLNDVKVLCELPESYEAYRKQQHRWHSGPMHLFWLCLPDILTAKISSWKKANLILLFFLLRKLILPFYSFTLFCVILPLTMFVPEAELPVWVICYVPVCMSFLNILPSPRSFPFIVPYLLFENTMSVTKFNAMVSGLFKLGSSYEWIVTKKSGRSSESDLSTAVERDTKDLTLPRLQKQISESELIDLKMQKERQEKAPLGAKKANKIYKKELALSLLLLTAATRSLLSAQGIHFYFLLFQGVSFLFVGLDLIGEQID

SEQ ID NO: 76 - protein, 745 aa, Oryza sativa
MAPPPNTYSESWWGGKEERGTPVVVKMDNPYSLVEIDGPGMAAPSEKARGKNAKQLTWVLLLRAHRAVGCVAWLAAGFWAVLGAVNRRVRRSRDADAEPDAEASGRGRAMLRFLRGFLLLSLAMLAFETVAHLKGWHFPRSAAGLPEKYLRRLPEHLQHLPEHLRRHLPEHLRMPEKEEIEGWLHRAYVAWLAFRIDYIAWAIQKLSGFCIALFMVQSVDRLVLCLGCFWIKLRGIKPVADTSISNDDIEATAGDGGGYFPMVLIQMPMCNEKEVYETSISHVCQIDWPRERMLVQVLDDSDDETCQMLIKAEVTKWSQRGVNIIYRHRLNRTGYKAGNLKSAMSCDYVRDYEFVAIFDADFQPNPDFLKLTVPHFKGNPELGLVQARWSFVNKDENLLTRLQNINLCFHFEVEQQVNGVYLSFFGFNGTAGVWRIKALEDSGGWMERTTVEDMDIAVRAHLNGWKFIFLNDVKVLCELPESYQAYRKQQHRWHSGPMQLFRLCLPAVFKSKISTWKKANLVMLFFLLRKLILPFYSFTLFCVILPLTMFVPEAELPIWVICYVPVIMSVLNILPAPKSFPFVIPYLLFENTMSVTKFNAMVSGLFQLGSSYEWVVTKKAGRTSSESDILALAEAADADARPPPAKLHRGVSEGGLKEWAKLHKEQEDATAAAAAAAAPGTPVKKSKAAKAPNRIFKKELALAFLLLTAATRSLLSAQGLHFYFLLFQGVTFLAVGLDLIGEQVS

SEQ ID NO: 77 - protein, 572 aa, Oryza sativa
YGCIRVSLVLSLLLLAVEVAAYLQGWHLEEVASLLAVDGLFAASYAGWMRLRLDYLAPPLQFLTNASVALFMVQSIDRLVLCLGCFWIRFKGIKPVPQAAAAGKPDVEAGAGDYPMVLVQMPMCNEREVYQQSIGAVCNLDWPKSNFLVQVLDDSDDATTSALIKEEVEKWQREGVRIIYRHRVIRDGYKAGNLKSAMNCSYVKDYEFVVIFDADFQPQADFLKRTVPHFKGKDDVGLVQARWSFVNKDENLLTRLQNVNLCFHFEVEQQVNGAFLNFFGFNGTAGVWRIKALEDSGGWMERTTVEDMDIAVRAHLKGWKFVFLNDVECQCELPESYEAYRKQQHRWHSGPMQLFRLCFVDIIKSIGFWKKFNLIFLFFLLRKLILPFYSFTLFCVILPMTMFVPEAELPAWVVCYIPATMSILNILPAPKSFPFIVPYLLFENTMSVTKFNAMISGLFQLGSAYEWVVTKKSGRSSEGDLVGLVEKHSKQQRVGSAPNLDALTKEESNPKKDSKKKKHNRIYRKELALSFLLLTAAARSLLSAQGIHFYFLLFQGVSFLVVGLDLIGEQVE

SEQ ID NO: 78 - protein, 595 aa, Oryza sativa
MAPWSGLWGGKLAAGESPVLRSRFYAFIRAFVVLSVLLLIVELGAYINGWDDLAASALALPVIGVESLYASWLRFRATYVAPFIQFLTDACVVLFLIQSADRLIQCLGCFYIHLKRIKPNPKSPALPDAEDPDAAYYPMVLVQIPMCNEKEVYQQSIAAVCNLDWPRSNFLVQVLDDSDDPTTQTLIREEVLKWQQNGARIVYRHRVLRDGYKAGNLKSAMSCSYVKDYEFVAIFDADFQPNPDFLKRTVPHFKDNDELGLVQARWSFVNKDENLLTRLQNINLCFHFEVEQQVNGIFLNFFGFNGTAGVWRIKALDDSGGWMERTTVEDMDIAVRAHLRGWKFIFLNDVECQCELPESYEAYRKQQHRWHSGPMQLFRLCLPDIIKCKIVFWKKANLIFLFFLLRKLILPFYSFTLFCIILPMTMFVPEAELPDWVVCYIPALMSLLNILPSPKSFPFIIPYLLFENTMSVTKFNAMISGLFQLGNAYEWVVTKKSGRSSEGDLISLAPKELKHQKTESAPNLDAIAKEQSAPRKDVKKKLNRIYKKELALSLLLLTAAARSLLSKQGIHFYFLLFQGISFLLVGLDLIGEQIE

SEQ ID NO: 79 - protein, 1127 aa, Oryza sativa
MASKGILKNGGKPPTAPSSAAPTVVFGRRTDSGRFISYSRDDLDSEISSVDFQDYHVHIPMTPDNQPMDPAAGDEQQYVSSSLFTGGFNSVTRAHVMEKQASSARATVSACMVQGCGSKIMRNGRGADILPCECDFKICVDCFTDAVKGGGGVCPGCKEPYKHAEWEEVVSASNHDAINRALSLPHGHGHGPKMERRLSLVKQNGGAPGEFDHNRWLFETKGTYGYGNAIWPEDDGVAGHPKELMSKPWRPLTRKLRIQAAVISPYRLLVLIRLVALGLFLMWRIKHQNEDAIWLWGMSIVCELWFALSWVLDQLPKLCPINRATDLSVLKDKFETPTPSNPTGKSDLPGIDIFVSTADPEKEPVLVTANTILSILAADYPVDKLACYVSDDGGALLTFEAMAEAASFANLWVPFCRKHEIEPRNPDSYFNLKRDPFKNKVKGDFVKDRRRVKREYDEFKVRVNGLPDAIRRRSDAYHAREEIQAMNLQREKMKAGGDEQQLEPIKIPKATWMADGTHWPGTWLQASPEHARGDHAGIIQVMLKPPSPSPSSSGGDMEKRVDLSGVDTRLPMLVYVSREKRPGYDHNKKAGAMNALVRASAIMSNGPFILNLDCDHYVYNSKAFREGMCFMMDRGGDRLCYVQFPQRFEGIDPSDRYANHNTVFFDVNMRALDGLQGPVYVGTGCLFRRIALYGFDPPRSKDHTTPWSCCLPRRRRTRSQPQPQEEEEETMALRMDMDGAMNMASFPKKFGNSSFLIDSIPVAEFQGRPLADHPSVKNGRPPGALTIPRETLDASIVAEAISVVSCWYEEKTEWGTRVGWIYGSVTEDVVTGYRMHNRGWKSVYCVTHRDAFRGTAPINLTDRLHQVLRWATGSVEIFFSRNNALFASSKMKVLQRIAYLNVGIYPFTSVFLIVYCFLPALSLFSGQFIVQTLNVTFLTYLLIITITLCLLAMLEIKWSGIALEEWWRNEQFWLIGGTSAHLAAVLQGLLKVIAGIEISFTLTSKQLGDDVDDEFAELYAVKWTSLMIPPLTIIMINLVAIAVGFSRTIYSTIPQWSKLLGGVFFSFWVLAHLYPFAKGLMGRRGRTPTIVYVWSGLVAITISLLWIAIKPPSAQANSQLGGSFSFP

SEQ ID NO: 80 - protein, 1170 aa, Oryza sativa
MASSGGGGLRHSNSSRLSRMSYSGEDGRAQAPGGGGDRPMVTFARRTHSGRYVSYSRDDLDSELGNSGDMSPESGQEFLNYHVTIPATPDNQPMDPAISARVEEQYVSNSLFTGGFNSVTRAHLMDKVIESEASHPQMAGAKGSSCAINGCDAKVMSDERGDDILPCECDFKICADCFADAVKNGGACPGCKDPYKATELDDVVGARPTLSLPPPPGGLPASRMERRLSIMRSQKAMTRSQTGDWDHNRWLFETKGTYGYGNAIWPKENEVDNGGGGGGGGGLGGGDGQPAEFTSKPWRPLTRKLKIPAGVLSPYRLLILIRMAVLGLFLAWRIKHKNEDAMWLWGMSVVCELWFGLSWLLDQLPKLCPVNRATDLAVLKDKFETPTPSNPNGRSDLPGLDIFVSTADPEKEPPLVTANTILSILAADYPVEKLSCYVSDDGGALLTFEAMAEAASFANMWVPFCRKHDIEPRNPESYFNLKRDPYKNKVRSDFVKDRRRVKREYDEFKVRINSLPDSIRRRSDAYHAREEIKAMKRQREAALDDVVEAVKIPKATWMADGTHWPGTWIQPSAEHARGDHAGIIQVMLKPPSDDPLYGTSGEEGRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGIMGPVYVGTGCLFRRIALYGFDPPRSKEHSGCCSCCFPQRRKVKTSTVASEERQALRMADFDDEEMNMSQFPKKFGNSNFLINSIPIAEFQGRPLADHPGVKNGRPPGALTVPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASRKMKFLQRIAYLNVGIYPFTSIFLIVYCFLPALSLFSGQFIVRTLNVTFLTYLLVITLTMCMLAVLEIKWSGISLEEWWRNEQFWLIGGTSAHLAAVLQGLLKVIAGIEISFTLTSKSGGDEADDEFADLYIVKWTSLMIPPIVIMMVNLIAIAVGFSRTIYSEIPQWSKLLGGVFFSFWVLAHLYPFAKGLMGRRGRTPTIVFVWSGLLAITISLLWVAINPPSQNSQIGGSFTFP

SEQ ID NO: 81 - protein, 1148 aa, Oryza sativa
MSTGPGKKAIRNAGGVGGGAGPSAGGPRGPAGQAVKFARRTSSGRYVSLSREDIDMEGELAADYTNYTVQIPPTPDNQPMLNGAEPASVAMKAEEQYVSNSLFTGGFNSATRAHLMDKVIESSVSHPQMAGAKGSRCAMPACDGSAMRNERGEDVDPCECHFKICRDCYLDAQKDGCICPGCKEHYKIGEYADDDPHDGKLHLPGPGGGGNKSLLARNQNGEFDHNRWLFESSGTYGYGNAFWPKGGMYDDDLDDDVDKLGGDGGGGGGGGPLPEQKPFKPLTRKIPMPTSVISPYRIFIVIRMFVLLFYLTWRIRNPNMEALWLWGMSIVCELWFAFSWLLDMLPKVNPVNRSTDLAVLKEKFETPSPSNPHGRSDLPGLDVFVSTADPEKEPVLTTATTILSILAVDYPVEKLACYVSDDGGALLTFEAMAEAASFANVWVPFCKKHDIEPRNPDSYFSVKGDPTKGKRRNDFVKDRRRVKREFDEFKVRINGLPDSIRRRSDAFNAREDMKMLKHLRETGADPSEQPKVKKATWMADGSHWPGTWAASAPDHAKGNHAGILQVMLKPPSPDPLYGMHDDDQMIDFSDVDIRLPMLVYMSREKRPGYDHNKKAGAMNALVRCSAVMSNGPFMLNFDCDHYINNAQAVREAMCFFMDRGGERIAYIQFPQRFEGIDPSDRYANNNTVFFDGNMRALDGLQGPMYVGTGCMFRRFAVYGFDPPRSAEYTGWLFTKKKVTTFKDPESDTQTLKAEDFDAELTSHLVPRRFGNSSPFMASIPVAEFQARPLADHPAVLHGRPSGALTVPRPPLDPPTVAEAVSVISCWYEDKTEWGDRVGWIYGSVTEDVVTGYRMHNRGWRSVYCITKRDAFLGTAPINLTDRLHHQVLRWATGSVEIFFSRNNAFLASRKLMLLQRISYLNVGIYPFTSIFLLVYCFIPALSLFSGFFIVQKLDIAFLCYLLTMTITLVALGILEVKWSGIELEDWWRNEQFWLISGTSAHLYAVVQGLLKVMAGIEISFTLTAKAAADDNEDIYADLYIVKWSSLLIPPITIGMVNIIAIAFAFARTIYSDNPRWGKFIGGGFFSFWVLAHLNPFAKGLMGRRGKTPTIVFVWSGLLSITVSLLWVAISPPEANSNGGARGGGFQFP

SEQ ID NO: 82 - protein, 730 aa, Oryza sativa
METTAAATAAERRRPLFTTEELGGRAVYRVQAATVAAGILLVLYYRATRVPAAGEGRAAWLGMAAAELWFAVYWVIAQSVRWRPFRRRTFRDRLAERSRYEQNLPGVDIFVCTADPQSEPPSLVISTILSVMAYNYPSEKISVYLSDDGGSILTFYALWEASIFAKKWLPFCKRYNIEPRSPAAYFSESKVHHNLCIPKEWALIKRIDTATMSGKIPEEMKLKHKGFDEWNSDFTLKNHQPIVQLIDGKNRNAIDDDRNVLPTMVYVAREKRPQYHHNFKAGALNALIRVSSVISDSPVILNVDCDMYSNNSDSIRDALCFFLDEEMGQKIGFVQYPQIFNNMTQNDIYGNSFNVSYHVEMCGLDSVGGCLYIGTGCFHRREILCGRIFSKDYKENWNRGIKERGKENINEIEEKATSLVTCTYEHRTQWGNDIGVKYGFPAEDIITGLAIHCRGWESAFINPKRAAFLGLAPSTLAQNILQHKRWSEGNLTIFLSKYCSFLFGHGKIKLQLQMGYCICGLWAANSLPTLYYVVIPSLGLVKGTPLFPQIMSPWATPFIYVFCVKTLYGLYEALLSGDTLKGWWNGQRMWMVKSITSYLYGFIDTIRKCVGMSKMSFEVTAKVSGHDEAKRYEQEILEFGSSSPEYVIIATVALLNFVCLVGGLSQIMAGVWNMPWNVFLPQAILCGMIVIINMPIYEAMFLRKDNGRIPTAVTLASIGFVMLAFLVPIV

SEQ ID NO: 83 - protein, 623 aa, Oryza sativa
MSFGACMKKKLDIFVCTADPHSEPPSLVISTVVSVMAYNYPSKKLRVYLSDDGGSILTFYALWEASVFAKHWLPFCKKYNIEPRPPAAFFVESEGHHNLCTPKEWSFIKRIDTAVMLGKIPEEIKLNHKGFDGRNSRNCLKNHPPIVQVLIDGKSQNVVDDDGNVLPSLVYMAREKRPQYHHNFKSWAMNALICNNPIILNVDCDMYSNNSDSIRGTLCFFLDEEMGHKIGFVQPQLYNMTKNNIYGNSLLVLNEVSCIKLPIHNIGTGRFHIREILCVGGSAKTTRKTGRGIKEKTQADIYEIEIKAKSLATCTCEHRTQWGNEIEIKYGCTVEDIFTELAINCRGWESVYINPQRAALLGVGPATLAQTILQRKRWGEDNLTLFFSKNCPFLIGHGKIKLQLQMGYCLFGLWASNSLPTLYYVMFPSLGVKGTPLFPEIMSPWATPFVYVLCFNCEEYIQFLYEALLSGDTLKGCWNGQRMWMVRRITSYLYDLIDTIRKLLGLSKMTFAVTAKVSNRDEAKRYKQEIIELGSSYPEYVIIVIVALLNLVCLVEVLSQIMTGVWNMPWNVFLTQVILCGMIVITSIPIYEAMFLRKDKGRIPSSVTLASLGFVMLAFLIKY

SEQ ID NO: 84 - protein, 860 aa, Oryza sativa
MSAAAAVTSWTNGCWSPAATRVNDGGKDDVWVAVDEADVSGARGSDGGGRPPLFQTYKVKGSILHPYRFLILARLIAIVAFFAWRIRHKNRDGAWLWTMSMVGDVWFGFSWVLNQLPKQSPIKRVPDIAALADRHSGDLPGVDVFVTTVDPVDEPILYTVNTILSILAADYPVDRYACYLSDDGGTLVHYEAMVEVAKFAELWVPFCRKHCVEPRSPENYFAMKTQAYKGGVPGELMSDHRRVRREYEEFKVRIDSLSSTIRQRSDVYNAKHAGENATWMADGTHWPGTWFEPADNHQRGKHAGIVQVLLNHPSCKPRLGLAASAENPVDFSGVDVRLPMLVYISREKRPGYNHQKKAGAMNVMLRVSALLSNAPFVINFDGDHYVNNSQAFRAPMCFMLDGRGRGGENTAFVQFPQRFDDVDPTDRYANHNRVFFDGTMLSLNGLQGPSYLGTGTMFRRVALYGVEPPRWGAAASQIKAMDIANKFGSSTSFVGTMLDGANQERSITPLAVLDESVAGDLAALTACAYEDGTSWGRDVGWVYNIATEDVVTGFRMHRQGWRSVYASVEPAAFRGTAPINLTERLYQILRWSGGSLEMFFSHSNALLAGRRLHPLQRVAYLNMSTYPIVTVFIFFYNLFPVMWLISEQYYIQRPFGEYLLYLVAVIAMIHVIGMFEVKWAGITLLDWCRNEQFYMIGSTGVYPTAVLYMALKLVTGKGIYFRLTSKQTAASSGDKFADLYTVRWVPLLIPTIVIMVVNVAAVGVAVGKAAAWGPLTEPGWLAVLGMVFNVWILVLLYPFALGVMGQWGKRPAVLFVAMAMAVAAVAAMYVAFGAPYQAELSGVAASLGKVAAASLTGPSG

SEQ ID NO: 85 - protein, 889 aa, Oryza sativa
MAATAASTMSAAAAVTRRINAALRVDATSGDVAAGADGQNGRRSPVAKRVNDGGGGKDDVWVAVDEKDVCGARGGDGAARPPLFRTYKVKGSILHPYRFLILLRLIAIVAFFAWRVRHKNRDGVWLWTMSMVGDVWFGFSWVLNQLPKLSPIKRVPDLAALADRHSGDLPGVDVFVTTVDPVDEPILYTVNTILSILAADYPVDRYACYLSDDGGTLVHYEAMVEVAKFAELWVPFCRKHCVEPRSPENYFAMKTQAYKGGVPGELMSDHRRVRREYEEFKVRIDSLSSTIRQRSDVYNAKHAGENATWMADGTHWPGTWFEPADNHQRGKHAGIVQVLLNHPSCKPRLGLAASAENPVDFSGVDVRLPMLVYISREKRPGYNHQKKAGAMNVMLRVSALLSNAPFVINFDGDHYVNNSQAFRAPMCFMLDGRGRGGENTAFVQFPQRFDDVDPTDRYANHNRVFFDGTMLSLNGLQGPSYLGTGTMFRRVALYGVEPPRWGAAASQIKAMDIANKFGSSTSFVGTMLDGANQERSITPLAVLDESVAGDLAALTACAYEDGTSWGRDVGWVYNIATEDVVTGFRMHRQGWRSVYASVEPAAFRGTAPINLTERLYQILRWSGGSLEMFFSHSNALLAGRRLHPLQRVAYLNMSTYPIVTVFIFFYNLFPVMWLISEQYYIQRPFGEYLLYLVAVIAMIHVIGMFEVKWAGITLLDWCRNEQFYMIGSTGVYPTAVLYMALKLVTGKGIYFRLTSKQTTASSGDKFADLYTVRWVPLLIPTIVIIVVNVAAVGVAVGKAAAWGPLTEPGWLAVLGMVFNVWILVLLYPFALGVMGQWGKRPAVLFVAMAMAVAAVAAMYVAFGAPYQAELSGGAASLGKAAASLTGPSG

SEQ ID NO: 86 - protein, 868 aa, Oryza sativa
MASPASVAGGGEDSNGCSSLIDPLLVSRTSSIGGAERKAAGGGGGGAKGKHWAAADKGERRAAKECGGEDGRRPLLFRSYRVKGSLLHPYRALIFARLIAVLLFFGWRIRHNNSDIMWFWTMSVAGDVWFGFSWLLNQLPKFNPVKTIPDLTALRQYCDLADGSYRLPGIDVFVTTADPIDEPVLYTMNCVLSILAADYPVDRSACYLSDDSGALILYEALVETAKFATLWVPFCRKHCIEPRSPESYFELEAPSYTGSAPEEFKNDSRIVHLEYDEFKVRLEALPETIRKRSDVYNSMKTDQGAPNATWMANGTQWPGTWIEPIENHRKGHHAGIVKVVLDHPIRGHNLSLKDSTGNNLNFNATDVRIPMLVYVSRGKNPNYDHNKKAGALNAQLRASALLSNAQFIINFDCDHYINNSQAFRAAICFMLDQREGDNTAFVQFPQRFDNVDPKDRYGNHNRVFFDGTMLALNGLQGPSYLGTGCMFRRLALYGIDPPHWRQDNITPEASKFGNSILLLESVLEALNQDRFATPSPVNDIFVNELEMVVSASFDKETDWGKGVGYIYDIATEDIVTGFRIHGQGWRSMYCTMEHDAFCGTAPINLTERLHQIVRWSGGSLEMFFSHNNPLIGGRRLQPLQRVSYLNMTIYPVTSLFILLYAISPVMWLIPDEVYIQRPFTRYVVYLLVIILMIHMIGWLEIKWAGITWLDYWRNEQFFMIGSTSAYPTAVLHMVVNLLTKKGIHFRVTSKQTTADTNDKFADLYEMRWVPMLIPTMVVLVANIGAIGVAIGKTAVYMGVWTIAQKRHAAMGLLFNMWVMFLLYPFALAIMGRWAKRSIILVVLLPIIFVIVALVYVATHILLANIIPF

SEQ ID NO: 87 - protein, 889 aa, Oryza sativa
MSAAAVTRRINAGGLRVEVTNGNGAAGVYVAAAAAPCSPAAKRVNDGGGKDDVWVAVDEADVSGPSGGDGVRPTLFRTYKVKGSILHPYRVLDPSSTDRHRRFFAWRVRHKNRDGAWLWTMSMAGDVWFGFSWALQQLPKLNPIKRVADLAALADRQQHGTSGGGELPGVDVFVTTVDPVDEPILYTVNSILSILAADYPVDRYACYLSDDGGTLVHYEAMVEVAKFAELWVPFCRKHCVEPRAPESYFAMKTQAYRGGVAGELMSDRRRVRREYEEFKVRIDSLFSTIRKRSDAYNRAKDGKDDGENATWMADGTHWPGTWFEPAENHRKGQHAGIVQVLLNHPTSKPRFGVAASVDNPLDFSGVDVRLPMLVYISREKRPGYNHQKKAGAMNALLRVSALLSNAPFIINFDCDHYVNNSQAFRAPMCFMLDRRGGGDDVAFVQFPQRFDDVDPTDRYANHNRVFFDGTTLSLNGLQGPSYLGTGTMFRRAALYGLEPPRWGAAGSQIKAMDNANKFGASSTLVSSMLDGANQERSITPPVAIDGSVARDLAAVTACGYDLGTSWGRDAGWVYDIATEDVATGFRMHQQGWRSVYTSMEPAAFRGTAPINLTERLYQILRWSGGSLEMFFSHSNALLAGRRLHPLQRIAYLNMSTYPIVTVFIFFYNLFPVMWLISEQYYIQQPFGEYLLYLVAIIAMIHVIGMFEVKWSGITVLDWCRNEQFYMIGSTGVYPTAVLYMALKLFTGKGIHFRLTSKQTTASSGDKFADLYTVRWVPLLIPTIVVLAVNVGAVGVAVGKAAAWGLLTEQGRFAVLGMVFNVWILALLYPFALGIMGQRGKRPAVLFVATVMAVAAVAIMYAAFGAPYQAGLSGVAASLGKAASLTGPSG

SEQ ID NO: 88 - protein, 830 aa, Oryza sativa
MPPSAGLATESLPAATCPAKKDAYAAAASPESETKLAAGDERAPLVRTTRISTTTIKLYRLTIFVRIAIFVLFFKWRITYAARAISSTDAGGIGMSKAATFWTASIAGELWFAFMWVLDQLPKTMPVRRAVDVTALNDDTLLPAMDVFVTTADPDKEPPLATANTVLSILAAGYPAGKVTCYVSDDAGAEVTRGAVVEAARFAALWVPFCRKHGVEPRNPEAYFNGGEGGGGGGKARVVARGSYKGRAWPELVRDRRRVRREYEEMRLRIDALQAADARRRRCGAADDHAGVVQVLIDSAGSAPQLGVADGSKLIDLASVDVRLPALVYVCREKRRGRAHHRKAGAMNALLRASAVLSNAPFILNLDCDHYVNNSQALRAGICFMIERRGGGAEDAGDVAFVQFPQRFDGVDPGDRYANHNRVFFDCTELGLDGLQGPIYVGTGCLFRRVALYGVDPPRWRSPGGGVAADPAKFGESAPFLASVRAEQSHSRDDGDAIAEASALVSCAYEDGTAWGRDVGWVYGTVTEDVATGFCMHRRGWRSAYYAAAPDAFRGTAPINLADRLHQVLRWAAGSLEIFFSRNNALLAGGRRRLHPLQRAAYLNTTVYPFTSLFLMAYCLFPAIPLIAGGGGWNAAPTPTYVAFLAALMVTLAAVAVLETRWSGIALGEWWRNEQFWMVSATSAYLAAVAQVALKVATGKEISFKLTSKHLASSATPVAGKDRQYAELYAVRWTALMAPTAAALAVNVASMAAAGGGGRWWWWDAPSAAAAAAAALPVAFNVWVVVHLYPFALGLMGRRSKAVRPILFLFAVVAYLAVRFLCLLLQFHTA

SEQ ID NO: 89 - protein, 750 aa, Oryza sativa
MEAAARGNKKLQERVPIRRTAWRLADLAILFLLLALLLHRVLHDSGAPWRRAALACEAWFTFMWLLNVNAKWSPVRFDTFPENLAERIDELPAVDMFVTTADPVLEPPLVTVNTVLSLLALDYPAAGEKLACYVSDDGCSPLTCYALREAARFARTWVPFCRRHGVAVRAPFRYFSSTPEFGPADGKFLEDWTFMKSEYEKLVHRIEDADEPSLLRHGGGEFAEFLDVERGNHPTIIKVLWDNNRSRTGDGFPRLIYVSREKSPNLHHHYKAGAMNALTRVSALMTNAPFMLNLDCDMFVNNPRVVLHAMCLLLGFDDEISCAFVQTPQKFYGALKDDPFGNQLEVSLMKVGRGIAGLQGIFYCGTGCFHRRKVIYGMRTGREGTTGYSSNKELHSKFGSSNNFKESARDVIYGNLSTEPIVDISSCVDVAKEVAACNYEIGTCWGQEVGWVYGSLTEDVLTGQRIHAAGWRSTLMEIEPPAFMGCAPNGGPACLTQLKRWASGFLEILISRNNPILTTTFKSLQFRQCLAYLHSYVWPVRAPFELCYALLGPYCLLSNQSFLPKTSEDGFYIALALFIAYNTYMFMEFIECGQSARACWNNHRMQRITSASAWLLAFLTVILKTLGFSETVFEVTRKDKSTSDGDSNTDEPEPGRFTFDESTVFIPVTALAMLSVIAIAVGAWRVVLVTTEGLPGGPGISEFISCGWLVLCFMPLLRGLVGSGRYGIPWSIKMKACLLVAIFLLFCKRN

SEQ ID NO: 90 - protein, 762 aa, Oryza sativa
MAVVAAAAATGSTTRSGGGGGEGTRSGRKKPPPPPLQERVPLGRRAAWAWRLAGLAVLLLLLALLALRLLRHHGGAGGDAGVWRVALVCEAWFAALCALNVSAKWSPVRFVTRPENLVAEGRTPSTTAAEYGELPAVDMLVTTADPALEPPLVTVNTVLSLLALDYPRAGERLACYVSDDGCSPLTCHALREAAGFAAAWVPFCRRYGVAVRAPFRYFSSSSSPESGGPADRKFLDDWTFMKDEYDKLVRRIKNTDERSLLRHGGGEFFAEFLNVERRNHPTIVKTRVSAVMTNAPIMLNMDCDMFVNNPQAVLHAMCLLLGFDDEASSGFVQAPQRFYDALKDDPFGNQMECFFKRFISGVQGVQGAFYAGTGCFHRRKAVYGVPPNFNGAEREDTIGSSSYKELHTRFGNSEELNESARNIIWDLSSKPMVDISSRIEVAKAVSACNYDIGTCWGQEVGWVYGSLTEDILTGQRIHAMGWRSVLMVTEPPAFMGSAPIGGPACLTQFKRWATGQSEIIISRNNPILATMFKRLKFRQCLAYLIVLGWPLRAPFELCYGLLGPYCILTNQSFLPKASEDGFSVPLALFISYNTYNFMEYMACGLSARAWWNNHRMQRIISVSAWTLAFLTVLLKSLGLSETVFEVTGKDKSMSDDDDNTDGADPGRFTFDSLPVFIPVTALAMLNIVAVTVGACRVAFGTAEGVPCAPGIGEFMCCGWLVLCFFPFVRGIVWGKGSYGIPWSVKLKASLLVAMFVTFCKRN

SEQ ID NO: 91 - protein, 534 aa, Po; identical to SEQ ID NO: 2

SEQ ID NO: 92 - protein, 534 aa, Plantango psyllium
MAESGSTGGLPMLVDQLVKIWLEVRGPVVAPVLQFAINVCLVMVTMLFVERIFMCGVMVFVKLLRRTPETQFKFEAIQDDLEFGNSSYPMVLVQIPMFNEREVYQLSIQAACGLSWPQDRMIIQVLDDSTDQTTRELVQVEVQRWASKGINIKYETRPNRKGYKAGALRQGMRHPYVQTCDYVAIFDADFQPEPEFLQRTVPFLVHNSNLALVQARWKFVNANECLMTKMQEVSLNYHFSVEQRVGSATYGFFGFNGTAGVWRIRAMEEAGGWNDRTTVEDMDLAVRASLCGWKFVYIHDLEVKNELPSTFKAFRFQQHRWSCGPANLFRKVLFTILKNQNLRLWKRLHMIYAFFFVRKIVAHIVTFTFYCVVIPASVLVPEVDLPFWGAVYVPSIITLLNAITTPKSLHLLVFWILFENVMSLHRTKATIIGLFDIGNVNEWVVTEKLGNLMKYRSAKYGKKYTLQRMASNMLARGWKMSERLHILELWTGGFLMFCAVYDFYFQGKNHFYVYLFLQSCAFLIMGFGYVGTFV

SEQ ID NO: 93 - protein, 530 aa, Pt
MDRLSSANLLPESFPSNDMTEQLALIWRQIRAPLIAPLLRFAVGICLIMSLMLFIERVYMAVVIVLVKLFGKRPEKRYKWEPIRDDIELGNSAYPMVLVQIPMYNEKEVYQLSIGAACGLSWPSDRIIIQVLDDSTDPAIKELVTMECQRWASKGINIKYEIRDNRNGYKAGALKEGMKRSYVKDCDYVAIFDADFQPEPDYLWRTVPFLVHNPELALVQARWKFVNSDECLMTRMQEMSLDYHFTVEQEVGSSTHAFFGFNGTAGVWRINALNEAGGWKDRTTVEDMDLAVRASLKGWKFVFVGDLKVKNELPSTFKAYRYQQHRWSCGPANLFRKMVMEILRNKRVTPWKKFHVIYAFFFVRKIVAHIVTFTFYCVVIPATVLVPEVQVPKWGAVYIPSIITLLNAVSTPKSLHLLVFWILFENVMSLHRTKATFIGLLEAGRVNEWVVTEKLGDAMKHKSGKQIKKSRSRIGERLHVLELFAGVYLFFCASYDLAFGRNHFYIYLYLQAAAFFVMGFGYIGTFVPTS

SEQ ID NO: 94 - protein, 534 aa, Pt
MDRLSYSSANILPQTFQGTRDDIVEQIALLWQQIRAPLVAPLLNICIYFCLLMSVMLFIERVYMAVVIVLIKLFGKKPEKRYKWGAIKEDVELGNSVYPMVLVQIPMYNEREVYQLSIGAACALSWPSNRVIIQVLDDSTDLTIKDLVEMECQKWASKGINIKYEIRGNRNGYKAGALKEGMKHSYVRECDYVVIFDADFQPDRDFLSRTIPFLVHNPELALVQARWKFVNADECLMTRMQEMSLDYHFTVEQEVGSATHAFFGFNGTAGVWRIKALNEAGGWKDRTTVEDMDLAVRASLRGWKFVFVGDLGVKNELPSTFKAYRYQQHRWSCGPANLFRKMVREIIANKKVSAWKKFHVIYGFFFVRKIVAHIVTFVFYCVVIPTTVLVPEVQLPKWGAVYIPSTITLLNAVSTPRSLHLLVFWILFENVMSLHRTKATIIGLFEAGRVNEWVVTEKLGDALKHKTAKQMKRSQSRIGERIHVLEVLTGVYLFFCASYDLAFGKNHFYIYLFLQAGAFFIMGFGYIGTFVPTY

SEQ ID NO: 95 - protein, 1075 aa, Zea mays
  misc_feature (245)..(245): Xaa can be any naturally occurring amino acid
MAANKGMVAGSHNRNEFVMIRHDGDVPGSAKPTKSANGQVCQICGDSVGVSATGDVFVACNECAFPVCRPCYEYERKEGNQCCPQCKTRYKRQKGSPRVHGDEDEEDVDDLDNEFNYKQGSGKGPEWQLQGDDADLSSSARHEPHHRIPRLTSGQQISGEIPDASPDRHSIRSPTSSYVDPSVPVPVRIVDPSKDLNSYGLNSVDWKERVESWRVKQDKNMMQVTNKYPEARGGDMEGTGSNGEXMQMVDDARLPLSRIVPISSNQLNLYRVVIILRLIILCFFFQYRVSHPVRDAYGLWLVSVICEVWFALSWLLDQFPKWYPINRETYLDRLALRYDREGEPSQLAPIDVFVSTVDPLKEPPLITANTVLSILSVDYPVDKVSCYVSDDGSAMLTFESLSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVIKSCCGRRKKKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 96 - protein, 1078 aa, Zea mays
MDAGSVTGGLAAGSHMRDELHVMRAREEPNAKVRSADVKTCRVCADEVGTREDGQPFVACAECGFPVCRPCYEYERSEGTQCCPQCNTRYKRQKGCPRVEGDEEEGPEMDDFEDEFPAKSPKKPHEPVAFDVYSENGEHPAQKWRTGGQTLSSFTGSVAGKDLEAEREMEGSMEWKDRIDKWKTKQEKRGKLNHDDSDDDDDKNEDEYMLLAEARQPLWRKVPIPSSMINPYRIVIVLRLVVLCFFLKFRITTPATDAVPLWLASVICELWFAFSWILDQLPKWAPVTRETYLDRLALRYDREGEACRLSPIDFFVSTVDPLKEPPIITANTVLSILAVDYPVDRVSCYVSDDGASMLLFDALSETAEFARRWVPFCKKFAVEPRAPEFYFSQKIDYLKDKVQPTFVKERRAMKREYEEFKVRINALVAKAQKKPEEGWVMQDGTPWPGNNTRDHPGMIQVYLGNQGALDVEGHELPRLVYVSREKRPGYNHHKKAGAMNALVRVSAVLTNAPFILNLDCDHYVNNSKAVREAMCFLMDPQLGKKLCYVQFPQRFDGIDRHDRYANRNVVFFDINMKGLDGIQGPVYVGTGCVFNRQALYGYDPPRPEKRPKMTCDCWPSWCCCCCCFGGGKRGKARKDKKGDGGEEPRRGLLGFYRKRSKKDKLGGGSVAGSKKGGGLYKKHQRAFELEEIEEGLEGYDELERSSLMSQKSFEKRFGQSPVFIASTLVEDGGLPQGAAADPAALIKEAIHVISCGYEEKTEWGKEIGWIYGSVTEDILTGFKMHCRGWKSVYCTPTRPAFKGSAPINLSDRLHQVLRWALGSVEIFMSRHCPLRYAYGGRLKWLERFAYTNTIVYPFTSIPLLAYCTIPAVCLLTGKFIIPTLNNLASIWFIALFLSIIATSVLELRWSGVSIEDWWRNEQFWVIGGVSAHLFAVFQGFLKVLGGVDTSFTVTSKAAGDEADAFGDLYLFKWTTLLVPPTTLIIINMVGIVAGVSDAVNNGYGSWGPLFGKLFFSFWVIVHLYPFLKGLMGRQNRTPTIVVLWSILLASIFSLVWVRIDPFIPKAKGPILKPCGVEC

SEQ ID NO: 97 - protein, 1007 aa, Zea mays
MMESAAAQSCAACGDDARAACRACSYALCRACLDEDAAEGRTTCARCGGDYAAINPARASEGTEAEEEVVENHHTAGGLRERVTMGSHLNDRQDEVSHARTMSSLSGIGSELNDESGKPIWKNRVESWKEKKNEKKASAKKTAAKAQPPPVEEQIMDEKDLTDAYEPLSRVIPISKNKLTPYRAVIIMRLIVLGLFFHYRITNPVNSAFGLWMTSVICEIWFGFSWILDQFPKWYPINRETYVDRLIARYGDGEESGLAPVDFFVSTVDPLKEPPLITANTVLSILAVDYPVEKISCYVSDDGSAMLTFESLAETAEYARKWVPFCKKYAIEPRAPEFYFSQKIDYLKDKIHPSFVKERRAMKRDYEEYKVRINALVAKAQKTPDEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPTVGRDVCYVQFPQRFDGIDRSDRYANRNVVFFDVNMKGLDGLQGPVYVGTGCCFNRQALYGYGPPSLPALPKSSICSWCCCCCPKKKVERSEREINRDSRREDLESAIFNLREIDNYDEYERSMLISQMSFEKSFGLSSVFIESTLMENGGVPESANPSTLIKEAIHVISCGYEEKTEWGKEIGWIYGSVTEDILTGFKMHCRGWRSIYCMPVRPAFKGSAPINLSDRLHQVLRWALVSVEIFFSRHCPLWYGYGGGRLKWLQRLSYINTIVYPFTSLPLVAYCCLPAICLLTGKFIIPTLSNAATIWFLGLFMSIIVTSVLELRWSGIGIEDWWRNEQFWVIGGVSAHLFAVFQGILKMIAGLDTNFTVTAKATDDTEFGELYLFKWTTVLIPPTSILVLNLVGVVAGFSAALNSGYESWGPLFGKVFFAMWVIMHLYPFLKGLMGRQNRTPTIVVLWSVLLASVFSLLWVKIDPFVGGTETVNTNNCNTHLLIHHRSAAVVPRRTCFWCCKRGLPA

SEQ ID NO: 98 - protein, 1052 aa, Zea mays
MEASAGLVAGSHNRNELVLIRGHEDPKPLRALSGQVCEICGDEVGLTVDGDLFVACNECGFPVCRPCYEYERREGTQNCPQCKTRYKRLKGSPRVAGDDDEEDIDDLEHEFNIDDENQQRQLEGNMQNSQITEAMLHGRMSYGRGPDDGDGNNTPQIPPIITGSRSVPVSGEFPITNGYGHGEVSSSLHKRIHPYPVSEPGSAKWDEKKEVSWKERMDDWKSKQGILGGGADPEDMDADVALNDEARQPLSRKVSIASSKVNPYRMVIVVRLVVLAFFLRYRILHPVPDAIGLWLVSIICEIWFAISWILDQFPKWFPIDRETYLDRLSLRYEREGEPSLLSAVDLFVSTVDPLKEPPLVTANTVLSILAVDYPVDKVSCYVSDDGASMLTFESLSETAEFARKWVPFCKKFGIEPRAPEFYFSLKVDYLKDKVQPTFVQERRAMKREYEEFKVRINALVAKAMKVPAEGWIMKDGTPWPGNNTRDHPGMIQVFLGHSGGHDTEGNELPRLVYVSREKRPGFQHHKKAGAMNALIRVSAVLTNAPFMLNLDCDHYINNSKAIREAMCFLMDPQVGRKVCYVQFPQRFDGIDVHDRYANRNTVFFDINMKGLDGIQGPVYVGTGCVFRRQALYGYNPPKGPKRPKMVTCDCCPCFGRKKRKHAKDGLPEGTADMGVDSDKEMLMSHMNFEKRFGQSAAFVTSTLMEEGGVPPSSSPAALLKEAIHVISCGYEDKTDWGLELGWIYGSITEDILTGFKMHCRGWRSVYCMPKRAAFKGSAPINLSDRLNQVLRWALGSVEIFFSRHSPLLYGYKNGNLKWLERFAYINTTIYPFTSLPLLAYCTLPAVCLLTGKFIMPSISTFASLFFIALFMSIFATGILEMRWSGVSIEEWWRNEQFWVIGGVSAHLFAVVQGLLKVLAGIDTNFTVTSKATGDEDDEFAELYAFKWTTLLIPPTTLLIINVIGVVAGISDAINNGYQSWGPLFGKLFFAFWVIVHLYPFLKGLMGRQNRTPTVVVIWSILLASIFSLLWVRIDPFIVRTKGPDVRQCGINC

SEQ ID NO: 99 - protein, 1052 aa, Zea mays
MEANAGLVAGSHNRNELVLIRGHEDPKPLRALSGQVCEICGDEVGLTVDGDLFVACNECGFPVCRPCYEYERREGTQNCPQCKTRYKRLKGSPRVAGDDDEEDIDDLEHEFNIDDEKQRQLEGNMQNSQITEAMLHGKMSYGRGADDGEGNNTPQMPPIITGARSVPVSGEFPITNGYGHGELSSSLHKRIHPYPVSEPGSAKWDEKKEVSWKERMDDWKSKQGILGGGGGDPEDMDADVPLNDEARQPLSRKVSIASSKVNPYRMVIVVRLVVLAFFLRYRILHPVPDAIGLWLVSIICEIWFAVSWILDQFPKWFPIDRETYLDRLTLRYEREGEPSLLSSVDLFVSTVDPLKEPPLVTANTVLSILAVDYPVDKVSCYVSDDGASMLTFEALSETAEFARKWVPFCKKFCIEPRAPEFYFSLKVDYLKDKVQPTFVQERRAMKREYEEFKVRINALVAKAMKVPAEGWIMKDGTPWPGNNTRDHPGMIQVFLGHSGGHDTEGNELPRLVYVSREKRPGFQHHKKAGAMNALIRVSAVLTNAPFMLNLDCDHYINNSKAIREAMCFLMDPQVGRKVCYVQFPQRFDGIDMHDRYANRNTVFFDINMKGLDGIQGPVYVGTGCVFRRQALYGYNPPKGPKRPKMVTCDCCPCFGRKKRKDAKDGLPEGTADIGVDSDKEMLMSQMNFEKRFGQSAAFVTSTLMEEGGVPPSSSPAALLKEAIHVISCGYEDKTDWGLELGWIYGSITEDILTGFKMHCRGWRSVYCMPKRAAFKGSAPINLSDRLNQVLRWALGSVEIFFSRHSPLLYGYKNGNLKWLERFAYINTTIYPFTSLPLLAYCTLPAVCLLTGKFIMPSISTFASLFFIALFMSIFATGILEMRWSGVSIEEWWRNEQFWVIGGVSAHLFAVVQGLLKVLAGIDTNFTVTSKATGDEDDEFAELYAFKWTTLLIPPTTLLIINIIGVVAGISDAINNGYQSWGPLFGKLFFAFWVIVHLYPFLKGLMGRQNRTPTIVVIWSVLLASIFSLLWVRIDPFIVRTKGPDVRQCGINC

SEQ ID NO: 100 - protein, 1074 aa, Zea mays
MAANKGMVAGSHNRNEFVMIRHDGDAPVPAKPTKSANGQVCQICGDTVGVSATGDVFVACNECAFPVCRPCYEYERKEGNQCCPQCKTRYKRQKGSPRVHGDDEEEDVDDLDNEFNYKQGNGKGPEWQLQGDDADLSSSARHDPHHRIPRLTSGQQISGEIPDASPDRHSIRSPTSSYVDPSVPVPVRIVDPSKDLNSYGLNSVDWKERVESWRVKQDKNMLQVTNKYPEARGDMEGTGSNGEDMQMVDDARLPLSRIVPISSNQLNLYRIVIILRLIILCFFFQYRISHPVRNAYGLWLVSVICEVWFALSWLLDQFPKWYPINRETYLDRLALRYDREGEPSQLAPIDVFVSTVDPLKEPPLITANTVLSILAVDYPVDKVSCYVSDDGSAMLTFESLSETAEFARKWVPFCKKHNIEPRAPEFYFAQKIDYLKDKIQPSFVKERRAMKREYEEFKIRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVVKSCCGRRKRKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSVPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 101 - protein, 1069 aa, Zea mays
MEANRGMVAGSRGGVVTIRHDGDGAAAKQLKNVNEQICQICGDTLGLSATGDIFVACNECAFPVCRPCYEYERKEGNQCCPQCKTRYKRHKGSPRVRGDEEEDGVDDLDNEFNYTQGNVQGPQWQLQGQGEDVDISSSSRHEPHHRIPRLTTGQQMSGDIPDASPDRHSIRSPTPSYVDPSIPVPVRIVDPSKDLNSYGVGSVDWKERVESWKVRQDKNMIQVTHKYPAEGKGDIEGTGSKWADDARLPLSRIVPISPNELNLYRIVIVLRLIILCFFFQYRITHPVEDAYGLWLVSVICEVWFALSWLLDQFPKWYPINRETYLDRLALRYDREGEPSQLAPIDVFVSTVDPLKEPPLITGNTVLSILAVDYPVDKVSCYVSDDGSAMLTFEALSETAEFARKWVPFCKKHNIEPRAPEFYFARKIDYLKDKIQPSFVKERRAMKRECEEFKVRIDALVAKAQKIPEEGWTMADGTPWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIIIKSCCGGRKKKDKSYIDSKNRDMKRTESSAPIFNMEDIEEGFEGYEDERSLLMSQKSLEKRFGQSPIFIASTFMTQGGIPPSTNPGSLLKEAIHVISCGYEDKTEWGKEIGWIYGSVTEDILTGFKMHARGWISIYCMPLRPCFKGSAPINLSDRLNQVLRWALGSVEILLSRHCPIWYGYNGRLKLLERLAYINTIVYPITSIPLVAYCVLPAICLLTNKFIIPAISNYAGAFFILLFASIFATGILELRWSGVGIEDWWRNEQFWVIGGTSAHLFAVFQGLLKVLAGIDTNFTVTSKATDDDGDFAELYVFKWTTLLIPPTTVLVINLVGIVAGVSYAINSGYQSWGPLFGKLFFAIWVILHLYPFLKGLMGKQNRTPTIVIVWSVLLASIFSLLWVKIDPFISPTQKALSRGQCGVNC

SEQ ID NO: 102 - protein, 1077 aa, Zea mays
MEGDADGVKSGRRGGGQVCQICGDGVGTTAEGDVFAACDVCGFPVCRPCYEYERKDGTQACPQCKTKYKRHKGSPAIRGEEGDDTDADSDFNYLASGNEDQKQKIADRMRSWRMNVGGSGDVGRPKYDSGEIGLTKYDSGEIPRGYIPSVTNSQISGEIPGASPDHHMMSPTGNIGKRAPFPYVNHSPNPSREFSGSIGNVAWKERVDGWKMKQDKGTIPMTNGTSIAPSEGRGVGDIDASTDYNMEDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRVNGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKGGFLSSLCGGRKKASKSKKGSDKKKSQKHVDSSVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSIPLLIYCILPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 103 - protein, 1076 aa, Zea mays
  misc_feature (425)..(425): Xaa can be any naturally occurring amino acid
MDGGDATNSGKHVAGQVCQICGDGVGTAADGDLFTACDVCGFPVCRPCYEYERKDGTQACPQCKTKYKRHKGSPPVHGEENEDVDADDVSDYNYQASGNQDQKQKIAERMLTWRTNSRGSDIGLAKYDSGEIGHGKYDSGEIPRGYIPSLTHSQISGEIPGASPDHMMSPVGNIGRRGHQFPYVNHSPNPSREFSGSLGNVAWKERVDGWKMKDKGAIPMTNGTSIAPSEGRGVADIDASTDYNMEDALLNDETRQPLSRKVPIPSSRINPYRMVIVLRLAVLCIFLRYRITHPVNNAYPLWLLSVICEIWFALSWILDQFPKWSPINRETYLDRLALRYDREGEPSQLAPVDIFVSTVDPMKEPPLVTANTVLSILAVDYPVDKVSCYVSDDGAAMLTFDALSETSEFARKWVPFCKKYNIEPXAPEWYFAQKIDYLKDKVQTSFVKERRAMKREYEEFKVRINGLVAKAQKVPEEGWIMQDGTPWPGNNTRDHPGMIQVFLGHSGGLDVEGNELPRLVYVSREKRPGFQHHKKAGAMNALVRVSAVLTNGQYMLNLDCDHYINNSKALREAMCFLMDPNLGRNVCYVQFPQRFDGIDRNDRYANRNTVFFDINLRGLDGIQGPVYVGTGCVFNRTALYGYEPPVKKKKPGFFSSLCGGRKKTSKSKKSSEKKKSHRHADSSVPVFNLEDIEEGIEGSQFDDEKSLIMSQMSLEKRFGQSSVFVASTLMEYGGVPQSATPESLLKEAIHVISCGYEDKTDWGTEIGWIYGSVTEDILTGFKMHARGWRSIYCMPKRPAFKGSAPINLSDRLNQVLRWALGSIEILFSRHCPIWYGYGGRLKFLERFAYINTTIYPLTSIPLLLYCILPAVCLLTGKFIIPKISNLESVWFISLFISIFATGILEMRWSGVGIDEWWRNEQFWVIGGISAHLFAVFQGLLKVLAGIDTSFTVTSKATDEEGDFAELYMFKWTTLLIPPTTILIINLVGVVAGISYAINSGYQSWGPLFGKLFFAFWVIVHLYPFLKGLMGKQNRTPTIVVVWAILLASIFSLMWVRIDPFTTRVTGPDIAKCGINC

SEQ ID NO: 104 - protein, 1059 aa, Zea mays
MDQRNGQVCQICGDDVGRNPDGEPFVACNECAFPICRDCYEYERREGTQNCPQCKTRFKRFKGCARVPGDEEEDGVDDLENEFNWSDKHDSQYLAESMLHAHMSYGRGADLDGVPQPFHPIPNVPLLTNGQMVDDIPPDQHALVPSFVGGGGKRIHPLPYADPNLPVQPRSMDPSKDLAAYGYGSVAWKERMESWKQKQERMHQTRNDGGGDDGDDADLPLMDEARQPLSRKIPLPSSQINPYRMIIIIRLVVLCFFFHYRVMHPVPDAFALWLISVICEIWFAMSWILDQFPKWFPIERETYLDRLSLRFDKEGHPSQLAPVDFFVSTVDPLKEPPLVTANTVLSILSVDYPVDKVSCYVSDDGAAMLTFEALSETSEFAKKWVPFCKRYSLEPRAPEWYFQQKIDYLKDKVAPNFVRERRAMKREYEEFKVRINALVAKAQKVPEEGWTMQDGTPWPGNNVRDHPGMIQVFLGQSGGHDVEGNELPRLVYVSREKRPGYNHHKKAGAMNALVRVSAVLTNAPYLLNLDCDHYINNSKAIKEAMCFMMDPLLGKKVCYVQFPQRFDGIDRHDRYANRNVVFFDINMKGLDGIQGPIYVGTGCVFRRQALYGYDAPKTKKPPSRTCNCWPKWCICCCCFGNRKTKKKTKTSKPKFEKIKKLFKKKENQAPAYALGEIDEAAPGAENEKASIVNQQKLEKKFGQSSVFVASTLLENGGTLKSASPASLLKEAIHVISCGYEDKTGWGKDIGWIYGSVTEDILTGFKMHCHGWRSIYCIPKRAAFKGSAPLNLSDRFHQVLRWALGSIEILFSNHCPLWYGYGGGLKFLERFSYINSIVYPWTSIPLLAYCTLPAICLLTGKFITPELNNVASLWFMSLFICIFATSILEMRWSGVGIDDWWRNEQFWVIGGVSSHLFAVFQGLLKVIAGVDTSFTVTSKGGDDEEFSELYTFKWTTLLIPPTTLLLLNFIGVVAGISNAINNGYESWGPLFGKLFFAFWVIVHLYPFLKGLVGRQNRTPTIVIVWSILLASIFSLLWVRIDPFLAKDDGPLLEECGLDCN

SEQ ID NO: 105 - protein, 1086 aa, Zea mays
MEASAGLVAGSHNRNELVVIRRDGDPGPKPPREQNGQVCQICGDDVGLAPGGDPFVACNECAFPVCRDCYEYERREGTQNCPQCKTRYKRLKGCQRVTGDEEEDGVDDLDNEFNWDGHDSQSVAESMLYGHMSYGRGGDPNGAPQAFQLNPNVPLLTNGQMVDDIPPEQHALVPSFMGGGGKRIHPLPYADPSLPVQPRSMDPSKDLAAYGYGSVAWKERMENWKQRQERMHQTGNDGGGDDGDDADLPLMDEARQQLSRKIPLPSSQINPYRMIIIIRLVVLGFFFHYRVMHPVNDAFALWLISVICEIWFAMSWILDQFPKWFPIERETYLDRLSLRFDKEGQPSQLAPIDFFVSTVDPLKEPPLVTTNTVLSILSVDYPVDKVSCYVSDDGAAMLTFEALSETSEFAKKWVPFCKRYNIEPRAPEWYFQQKIDYLKDKVAANFVRERRAMKREYEEFKVRINALVAKAQKVPEEGWTMQDGTPWPGNNVRDHPGMIQVFLGQSGGLDCEGNELPRLVYVSREKRPGYNHHKKAGAMNALVRVSAVLTNAPYLLNLDCDHYINNSKAIKEAMCFMMDPLLGKKVCYVQFPQRFDGIDRHDRYANRNVVFFDINMKGLDGIQGPIYVGTGCVFRRQALYGYDAPKTKKPPSRTCNCWPKWCFCCCCFGNRKQKKTTKPKTEKKKLLFFKKEENQSPAYALGEIDEAAPGAENEKAGIVNQQKLEKKFGQSSVFVTSTLLENGGTLKSASPASLLKEAIHVISCGYEDKTDWGKEIGWIYGSVTEDILTGFKMHCHGWRSIYCIPKRVAFKGSAPLNLSDRLHQVLRWALGSIEIFFSNHCPLWYGYGGGLKFLERFSYINSIVYPWTSIPLLAYCTLPAICLLTGKFITPELNNVASLWFMSLFICIFATSILEMRWSGVGIDDWWRNEQFWVIGGVSSHLFAVFQGLLKVIAGVDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKDDGPLLEECGLDCN

SEQ ID NO: 106 - protein, 1094 aa, Zea mays
MEASAGLVAGSHNRNELVVIRRDRESGAAGGGAARRAEAPCQICGDEVGVGFDGEPFVACNECAFPVCRACYEYERREGSQACPQCRTRYKRLKGCPRVAGDEEEDGVDDLEGEFGLQDGAAHEDDPQYVAESMLRAQMSYGRGGDAHPGFSPVPNVPLLTNGQMVDDIPPEQHALVPSYMSGGGGGGKRIHPLPFADPNLPVQPRSMDPSKDLAAYGYGSVAWKERMEGWKQKQERLQHVRSEGGGDWDGDDADLPLMDEARQPLSRKVPISSSRINPYRMIIVIRLVVLGFFFHYRVMHPAKDAFALWLISVICEIWFAMSWILDQFPKWLPIERETYLDRLSLRFDKEGQPSQLAPIDFFVSTVDPTKEPPLVTANTVLSILSVDYPVEKVSCYVSDDGAAMLTFEALSETSEFAKKWVPFSKKFNIEPRAPEWYFQQKIDYLKDKVAASFVRERRAMKREYEEFKVRINALVAKAQKVPEEGWTMQDGSPWPGNNVRDHPGMIQVFLGQSGGRDVEGNELPRLVYVSREKRPGYNHHKKAGAMNALVRVSAVLSNAAYLLNLDCDHYINNSKAIKEAMCFMMDPLVGKKVCYVQFPQRFDGIDKNDRYANRNVVFFDINMKGLDGIQGPIYVGTGCVFRRQALYGYDAPKTKKPPSRTCNCWPKWCLSCCCSRNKNKKKTTKPKTEKKKRLFFKKAENPSPAYALGEIDEGAPGADIEKAGIVNQQKLEKKFGQSSVFVASTLLENGGTLKSASPASLLKEAIHVISCGYEDKTDWGKEIGWIYGSITEDILTGFKMHCHGWRSIYCIPKRPAFKGSAPLNLSDRLHQVLRWALGSVEIFFSKHCPLWYGYGGGLKFLERFSYINSIVYPWTSIPLLAYCTLPAICLLTGKFITPELTNVASIWFMALFICISVTGILEMRWSGVAIDDWWRNEQFWVIGGVSAHLFAVFQGLLKVFAGIDTSFTVTSKAGDDEEFSELYTFKWTTLLIPPTTLLLLNFIGVVAGISNAINNGYESWGPLFGKLFFAFWVIVHLYPFLKGLVGRQNRTPTIVIVWSILLASIFSLLWVRVDPFLAKSNGPLLEECGLDCN

SEQ ID NO: 107 - protein, 1079 aa, Zea mays
MEGDADGVKSGRRGGGQVCQICGDGVGTTAEGDVFTACDVCGFPVCRPCYEYERKDGTQACPQCKNKYKRHKGSPAIRGEEGDDTDADDASDFNYPASGNDDQKQKIADRMRSWRMNAGGSGDVGRPKYDSGEIGLTKYDSGEIPRGYIPSVTNSQISGEIPGASPDHHMMSPTGNIGRRAPFPYMNHSSNPSREFSGSVGNVAWKERVDGWKMKQDKGTIPMTNGTSIAPSEGRGVGDIDASTDYNMEDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKIRVNGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKGGFLSSLCGGRKKGSKSKKGSDKKKSQKHVDSSVPVFNLEDIEEGVEGAGFDDEKSLLMSQMSLEKRFGQSAAFVASTLMEYGGVPQSATPESLLKEAIHVISCGYEDKIEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSLPLLIYCILPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTNRVTGPDTRTCGINC

What is claimed is:

1. A method for altering the level of xylan present in the cell wall of a plant, when compared to a non-transformed plant, the method comprising:
    (a) introducing into a plant cell a recombinant expression cassette comprising a polynucleotide, wherein said polynucleotide comprises a nucleotide sequence selected from the group consisting of the nucleotide sequence set forth in SEQ ID NO:5; a sequence with at least 95% identity to SEQ ID NO:5; and a sequence encoding the amino acid sequence set forth in SEQ ID NO:6, wherein expression of the polynucleotide, alone or in combination with additional polynucleotides, alters the level of xylan, and wherein the polynucleotide is operably linked to a promoter;
    (b) culturing the plant cell under plant forming conditions to produce a plant; and
    (c) expressing the polynucleotide for a time sufficient to alter the level of xylan in the cell wall of the plant.

2. The method of claim 1 wherein said polynucleotide encodes a cellulose synthase-like protein having an amino acid sequence with at least 99% identity to SEQ ID NO:6, wherein said protein has xylan synthase activity.

3. The method of claim 1 wherein the level of xylan is increased.

4. The method of claim 1 wherein the level of xylan is decreased.

5. The method of claim 4 wherein said xylan is decreased by a method selected from the group consisting of: transposon tagging, co-suppression, anti-sense suppression, dsRNA interference, RNAi, microRNA interference, small interfering RNA, and hairpin RNA interference.

6. The method of claim 1 wherein the plant is a monocot.

7. The method of claim 6 wherein the monocot is selected from the group consisting of: maize, rice, sorghum, switchgrass, sugarcane, bamboo, and triticale.

8. The method of claim 1 wherein the plant is a dicot.

9. The method of claim 8 wherein the dicot is soybean, sunflower, safflower, alfalfa, potato, *Brassica* spp., cotton, tomato, tobacco, cassaya, banana, psyllium, pine, poplar, peanut, guar, locust bean, or fenugreek.

10. An isolated nucleic acid molecule comprising a nucleotide sequence selected from the group consisting of:
    (a) the nucleotide sequence set forth in SEQ ID NO:5;
    (b) a nucleotide sequence encoding the amino acid sequence set forth in SEQ ID NO:6;
    (c) a nucleotide sequence encoding a polypeptide having at Least 99% identity to the amino acid sequence set forth in SEQ ID NO:6, wherein said nucleotide sequence encodes a polypeptide having xylan synthase activity; and
    (d) the nucleotide sequence that is complementary to the nucleotide sequence of (a), (b), or (c).

11. An expression cassette comprising said nucleic acid molecule of claim 10 operably linked to a promoter that drives expression in a non-human host cell.

12. A vector comprising the expression cassette of claim 11.

13. A non-human host cell having stably incorporated in its genome the expression cassette of claim 11.

14. A plant cell having stably incorporated in its genome the expression cassette of claim 11.

15. A transformed plant comprising in its genome at least on stably incorporated nucleotide construct comprising a nucleotide sequence operably linked to a promoter that drives expression in a plant cell, wherein the isolated nucleotide sequence is selected from the group consisting of:
    (a) the nucleotide sequence set forth in SEQ ID NO:5;
    (b) a nucleotide sequence encoding the amino acid sequence set forth in SEQ ID NO:6;
    (c) a nucleotide sequence encoding a polypeptide having at Least 99% identity to the amino acid sequence set forth in SEQ ID NO:6, wherein said nucleotide sequence encodes a polypeptide having xylan synthase activity; and
    (d) the nucleotide sequence that is complementary to the nucleotide sequence of (a), (b), or (c).

16. The plant of claim 15, wherein said plant is a monocot.

17. The plant of claim 16, wherein the monocot is maize, rice, sorghum, switch-grass, sugarcane, bamboo, or triticale.

18. The plant of claim 15, wherein said plant is a dicot.

19. The plant of claim 18, wherein said dicot is soybean, sunflower, safflower, alfalfa, potato, *Brassica* spp., cotton, tomato, tobacco, cassaya, banana, psyllium, pine, poplar, peanut, guar, locust bean, or fenugreek.

20. Seed of the plant of claim 15, wherein said seed comprises said nucleotide construct.

21. A method of improving digestibility of a cereal plant comprising reducing the level or activity of a CsLA protein present in said plant so that xylose levels are decreased, wherein said step of reducing is accomplished by introducing into said plant a construct comprising a polynucleotide, wherein said polynucleotide comprises a nucleotide sequence selected from the group consisting of the nucleotide sequence of set forth in SEQ ID NO:5, a sequence with at least 95% sequence identity to SEQ ID NO:5, and a sequence encoding the amino acid sequence set forth in SEQ ID NO:6.

22. The method of claim 21 wherein said construct comprising said polynucleotide inhibits transcription or translation of said CsLA protein.

23. The method of claim 22 wherein said construct comprising said polynucleotide is a construct for one or more of the following methods: transposon tagging, co-suppression, anti-sense suppression, dsRNA interference, RNAi, microRNA interference, small interfering RNA, and hairpin RNA interference.

24. The method of claim 21 wherein said polynucleotide is operably linked to a promoter.

\* \* \* \* \*

UNITED STATES PATENT AND TRADEMARK OFFICE
CERTIFICATE OF CORRECTION

PATENT NO. : 8,173,866 B1
APPLICATION NO. : 12/319783
DATED : May 8, 2012
INVENTOR(S) : Bao et al.

It is certified that error appears in the above-identified patent and that said Letters Patent is hereby corrected as shown below:

Column 63, Claim 9, line 7, "cassaya" should be --cassava--;

Column 63, Claim 15, line 31, "on" should be --one--;

Column 63, Claim 15, line 33, delete "isolated";

Column 63, Claim 15, line 39, "Least" should be --least--; and

Column 64, Claim 19, line 12, "cassaya" should be --cassava--.

Signed and Sealed this
Thirty-first Day of July, 2012

David J. Kappos
*Director of the United States Patent and Trademark Office*